United States Patent 11,098,302 (IDENTIFICATION OF POLYNUCLEOTIDES ASSOCIATED WITH A SAMPLE) - sequence listing, part 96

SEQ ID NO: 331150 - DNA, 647 bp, Homo sapiens
  misc_feature: GZ8MTXP01B3QHB.17.57.F02.1.454.CMB.2.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgaccccagtcctccatccctccctgtctgcatctgtagganacagatccaccatctcgttggccgganaagtcagagcaattagacttaaactttaatggtatcgagacgggaaaccaagggaaacacccctaaactctagatactatactgctatacctaagtttgacgtaaaggtcgggtaccctagtacgtaggttcaggtcggaactagggtggtatcggtaggggactacgttactttccaccttctaccaacctatcgacgactaacgtctacgaacctaacgtaggtaacgtttactttacgaaccttaaacgtttaccttaacgtacgtaaccgtaaacggttaaccgggttactaaaccccgttaccccgttaaccgttaccgtttcgggacccggtaagggaacccaaggtccgttaggaacgtaacttaacgaaacgttaccgtgtacgtctacgacttacctcttcgttaac

SEQ ID NO: 331151 - DNA, 759 bp, Homo sapiens
  misc_feature: GZ8MTXP01C6V3E.17.57.F02.1.454.CMB.2.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
tcagcgtagactagcacgaccggtgctcgatttagctcgatatagttggggtttggggggcaggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcacctatctcgttcggccggganaagtcaagagctattagacttaaactttaaatggtatcgaaggacgggaaaccgaagggaaacacccctaaactcctagtatactatactgactacttaaccgtaatttacgacgtaaaacgggttcggggtacccctaagttaccggtaaagggtttcaagggtcggtaacgtaagggttgggtacttccggtagggggtaaactaaggttacttttaccaaccttaccgtacccaaccctaagttccgaacggtaccctaaggtttccacggtaacccaaaccgttagggtaacggtttaactttttcgaacccgtttaaaaccgtttaaccttaacgttacggtaaccgtaaacggttaacggggtttaaccctaaacccggttacccccgttaaacgttaccgggtttacgggaacccgggtaaacgggggaaacccttagggtacgttacgggaaacgtaacgttaaccgttaaaacggttacgtggtacgtcgtacgaccttaactcgttcgttaacg

SEQ ID NO: 331152 - DNA, 639 bp, Homo sapiens
  misc_feature: GZ8MTXP01BWCL6.17.57.F02.1.454.CMB.2.raw
  modified_base (617)..(617): a, c, t, g, unknown or other
  misc_feature (617)..(617): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagacgtcacctatctcgttcggccgggactaaaggtcaaggagtactaattaagacttaaactttttaaagtggtatacgaggaccgggaaaccaaggggaaacctcccctaaactcctagactactatactgactatacctaatttcgaacgtaaaggttccgggtacctagtacgtaaggttcaggtggactaggtacgatcggtagggactagtacttcactctacacatcagctagtctacgactaacgtgtagttagtttacactaacttactattacgtaacaacggtacggttacctaccgttacccgtacgttacgtttccgggacgtacgggtaaccgaacgtcgttacgggaaacaacgttaaccgaaacgttacgttgggttacggtaactcgaactaacgtnttccgttaacgttcgttaaccc

SEQ ID NO: 331153 - DNA, 664 bp, Homo sapiens
  misc_feature: GZ8MTXP01AFYFP.17.57.F02.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctctgccgggnaagtcagagctattagacttaaacttttaatggtatacgaggacgggaaccaagggaaaccacccctaaactcctagattactaatactgctactcctaatttcgacgtaaaggtcgggtaccctagtacgtaacggttcaggtcggacgtaggtagggatcggtagggaactagtactttcactctacacctatacagtctaagtctagaccgtaaccgttaggtacggttactttacgaaccttaaaccttacgtacgttacggttaaccaaaccggttacgggttaacctaacccggttaccccgttaacgttaccggtttcgggacccggtaacggggaaccctaaggtacgttaggggaaacttaacgtaaaccgtaaaacgttacgttgggttacggtccgtacgcctaacccgttcgttccgttcgttcctccg

SEQ ID NO: 331154 - DNA, 633 bp, Homo sapiens
  misc_feature: GZ8MTXP01DULYY.17.57.F02.1.454.CMB.2.raw
  modified_base (103)..(103): a, c, t, g, unknown or other
  misc_feature (103)..(103): n is a, c, g, or t
tcagcgtagactagcacgaccggtgctcgatttagctcgatatagttgggtttggggggagtcagtctcagtcaggacacagcatggacatgagggtccccgntcagctcctggggctcctgctactctggctccgaggtgccagatgtgacatccagatcgacccagtcctccactccctccctgtctgcatctagtaggagacagactccactatcctcgttcggccgggactaagtcaagacgtactattagactttaaattttaagtggtatcgaggaccggaaaccgaagggaaacctacccctaaactccgtagtacttactatacctagtactactactaagtttcgaacgtaacggtcggtaccagtacgtaacgtcgaggtcgactaggtagactgtgggaactagttactccactctacacctatcgacgctacgtcgtacgtactacgtgtagttacttcgaacttaacttacggtaactagtaacctaacggtacgttaactaccgttacccgttactcggttaccgacggtaacggacaagtcgttaggaacttacgtaaacgacgttaacgttcggttaaccgtcgtacgccttaacgtgttccttcgttccttaaccg

SEQ ID NO: 331155 - DNA, 616 bp, Homo sapiens
  misc_feature: GZ8MTXP01BJG2M.17.57.F02.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagatcaccatctcgttgccggganaagtcagngctattagacttaactttaatggtatcgaggaccgggaaaccgaagggaaacctcccctaaactcctagactctatactgactatactaattgactaaggtcgggtaccatacgtaaggttcaggtgactaggtgagtcgagggacagttacttcactctacacctatacgagctaacgtctacgaccaacgtgtaacggttatttacgacgtaaactttaacgttacgtagtaccgtaaacgttacgggttaaccgaacgtttaccccgtaacgttacgtttaccgggacggtaaccgggtaacgaagtccggttagaacgtaacgttaaccgaaacggttaagtcggtcggcttacggacccttactaacgttcgtcg

SEQ ID NO: 331156 - DNA, 597 bp, Homo sapiens
  misc_feature: GZ8MTXP01B7LHT.17.57.F02.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (407)..(407): a, c, t, g, unknown or other
  misc_feature (407)..(407): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtccacatctctcggccgganaagtcagagctattagacttaaactttaatggtatcgaaggacgggaaaccaagggaaacctacccctaaactcctagaacttctaagtactagactactactaagtttagacgtaaaggtcggtacccattacgagtcaggtgacagtggatcgaggacagtcttcactctacaccntacatcgtactctacgaccaacgttgtagttactttacgaccttaacttctaactacgtacaacgttacgtaacgtacccgtaaccgtcgtacgtttcggaccgtaacgggaaccttaggacgttaggaacgtacttaacgaacgttacgtaacggtcggtaactccggtcaccgtaacgttcgtttccg

SEQ ID NO: 331157 - DNA, 699 bp, Homo sapiens
  misc_feature: GZ8MTXP01DGNZS.17.57.F02.1.454.CMB.2.raw
  modified_base (231)..(231): a, c, t, g, unknown or other
  misc_feature (231)..(231): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctgtaggagacagatccaccatctcgtcggccggganaagtcagagctattagacttaaactttaatggtatcgagacggaaccgaaggaaacacccctaaactcctagactctaatactcgactacttacctaatttaggacgtaaaggtcggtaccctagtacgtaaggtcaggtcggaactaggtggatcgagggactagtctttacactctacactatacgagtacgtaacgttctaacgtaccctaaaccggttagaacggttttaacttttaccggaaaccgtttaaaacctttaaccgttaaccgttaaccggttaaccgtaaaaccgggtttaaccggggtttaaaccctaaaccccgggtttaaccccgttaaccgtttaccgggttttacccggggaacccggtaaacgggggtaaaccccagggtacccgttaaggggaaactaacgttaaaccgaaacgttacgtggtagctacgccttactcttccgtttcg

SEQ ID NO: 331158 - DNA, 560 bp, Homo sapiens
  misc_feature: GZ8MTXP01D2AY2.17.57.F02.1.454.CMB.2.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (275)..(275): a, c, t, g, unknown or other
  misc_feature (275)..(275): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctgtagganacagatcaccatctntgccgganagtcagancattagactaaatttaatgtatcgagacggaaacaggaacnccctaaatcctagatctatactgactacttacctaagtttgaacgtaaaggtcgggtaccctagtacgtaaggttcaggtcgacgtagtggactcgtagggactagtactttcactctcaccatcagctacgtctagacctaacgtgtaggtatttacgactaacttactactacgtaactaacgtacggttacctaccgtacccgtagtacgttcggacgtaacgggaccagcgttaggaatacttaacgaacgacgtgtacgctacgcttaacctcgttcgtg

SEQ ID NO: 331159 - DNA, 617 bp, Homo sapiens
  misc_feature: GZ8MTXP01AUW5S.17.57.F02.1.454.CMB.2.raw
  modified_base (232)..(232): a, c, t, g, unknown or other
  misc_feature (232)..(232): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatcctccctgtctgcatctggtaggagacagagtcaccatctcgttcggccggganaagtcagagctattagacttaaactttaaagtggtatcgaaggacgggaaaccaagggaaaccacccctaaactcctagtactctaatactcgactactacctaagtttcgaacgtaaaggtcgggtaccctaagtacgtaaggttcaaggtggactaggtggactcgtagggactagtacttacactctacaccatcagtctaacgtcacgacctaaacgtgtaacgttatttacgacttaaacgttacttactacgtaaccgtaaacgtacgggttaacctaccgttacccgtacgttacggttccgggacgtaacgggacttaggtcgaggtaacgaacttaacgaaacgacgtggtacgctcgacacgtcttcgttaaccg

SEQ ID NO: 331160 - DNA, 586 bp, Homo sapiens
  misc_feature: GZ8MTXP01EQGVR.17.57.F02.1.454.CMB.2.raw
  modified_base (417)..(417): a, c, t, g, unknown or other
  misc_feature (417)..(417): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccactcctccctgtctgcatctgtaggagacagagtcaccatctcgtcggccgggacaagtcagagctattagacttaaactttaaagtggtatcgaaggaccgggaaaccgaagggaaaccgcccctaaactcctagactctaatactgactactacctaatttgactaaaggtcgggtacccagtacgtaaggtcaggtcggactagtggatcgtgggactagtactttcactctcacctancagctagtctacactactgtaagttatttcgactaactttactacgtacgtacctaacgtacggttaaccaccgttaccccgtatacgtttcggaccgaacgggaaccagtcgttagaacgtacttaaccgaaacgttcgtggtagtcctacgccactaacgttcttcg

SEQ ID NO: 331161 - DNA, 574 bp, Homo sapiens
  misc_feature: GZ8MTXP01AUKM1.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctcctgtctgcatctgtaggagacagagtcaccatctcttcggccggcaagtcagagctattagactaaactttaatggtactcgaggaccgggaacaacgggaaacgtacccctaaactcctagattctaatacgtgacatacctaatttgaacgtaaaggtcggggtaccctagtacgtaaggttcaggtggactagggtggatcgtgggacagtattcactctcaccatcgatcagtcctgacctaaccgtgagtaatttgaactaacgttactactgacaacgtcgggttaacaccgtacctactacgttcgacgaaggggtaacagtcgttaggacaagttaccgaaacgttacgtaacgtggctacggacaccgtaacttcgttaacg

SEQ ID NO: 331162 - DNA, 608 bp, Homo sapiens
  misc_feature: GZ8MTXP01CTNLX.17.57.F02.1.454.CMB.2.raw
  modified_base (444)..(444): a, c, t, g, unknown or other
  misc_feature (444)..(444): n is a, c, g, or t
  modified_base (523)..(523): a, c, t, g, unknown or other
  misc_feature (523)..(523): n is a, c, g, or t
  modified_base (595)..(595): a, c, t, g, unknown or other
  misc_feature (595)..(595): n is a, c, g, or t
tcagcgtagactagcacgaccggtgctcgatttagctcgatatagttgggtttgggggcaggagtcggtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttcggccgggacaagtcagagctattagacttaaatttttaaatggtatcgaggacgggaaaccgagggaaaccacccctaaactcctagactctaatactgactactaccttaatttcgacgtaaaggttcggggtaccctaagtacccgtaaagggtttcgaggtcggacgtaagggtggtaagtcggtagggaactagttacttccactactacaaccatcganctagtctcgacctacgtgtagtactttacgacttaacttactacgtctaacgaacgttacgtacctacgttaacccctnttacgttcggacgacgggtaacaagcgtaggacgtaactacgaaacgttcgttgtaacgctcgacgtacttnttcgttcgttccc

SEQ ID NO: 331163 - DNA, 580 bp, Homo sapiens
  misc_feature: GZ8MTXP01B7C82.17.57.F02.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatctcttgccgggnaagtcagagcattagactaactttaaatggtatcagcgggaacaggaacncccctaaatcctagatctatactgctatcctaatttgactaaaggttcggggtaccccatcgaaaggtttcaaggtggacaggttggatcgtggggactaggtatttcacttctcaccatcagcagtctgactacctgaggttatttcgactaacttactactagtaccaacgtacgggttacaaccggttacccgtacgttaccgttttacggccgtaacgggggaccaaagggtccttagggaacgtaacgttaccgaaacggttacgtgggtacgcgttacggccaaccgtaacttcgttcg

SEQ ID NO: 331164 - DNA, 619 bp, Homo sapiens
  misc_feature: GZ8MTXP01BJP7Y.17.57.F02.1.454.CMB.2.raw
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (427)..(427): a, c, t, g, unknown or other
  misc_feature (427)..(427): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccactccctccctgtctgctatctaggtaggagacagagtccacctatctcgtggccgganaagtcaganactattagtacttaaactttaagtgtatcgacggacggaaaccgagggaaaccacccctaaactcctagactactatactgactactacctaattgaacgtaaaggtcgggtacctagtaccgtaaggttcgaggtgacgtagggtgatcgtgggactagtacttcactctacactatcganctaagtcacgacgtaacgtgtattatttacgacttaacgtttactactacgtaactaacgtacgggttacctaaccgttacccgtattcccggttacggaccggtaacggggtaacccaggtaccgttagggaaactaacttaacggaacgttacgtcggtacggtctacgaccttctaacgttcgttaacc

SEQ ID NO: 331165 - DNA, 637 bp, Homo sapiens
  misc_feature: GZ8MTXP01CNICI.17.57.F02.1.454.CMB.2.raw
  modified_base (223)..(223): a, c, t, g, unknown or other
  misc_feature (223)..(223): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctcgtgccgganagtcagagcattagtacttaaactttttaaatggtatacgaggaccgggaaccgaagggaaacctacccctaaactccgtagtactactatactgactacttacctaatttcgacgtaaaggtcgggtaccagtacgtaacggttcaggtggacgtggtaacggatcgtagggtaacagttattcacttcaccacctatcagctacgtcacgactaccgtagtaggttactttagactaaaccgttactacgttagtactaacggtacggttaaccctaccgttaaccccttacgttaccggtttcggaacccggtacgggtaacccaaggtacgttagggtaaacgttacgtaaaccgaacggttacgttgggttcgaacctcgaacctaccgtattccgtgttccgttaacc

SEQ ID NO: 331166 - DNA, 626 bp, Homo sapiens
  misc_feature: GZ8MTXP01AHC3E.17.57.F02.1.454.CMB.2.raw
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (284)..(284): a, c, t, g, unknown or other
  misc_feature (284)..(284): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtctccatccctccctgtctgcatctgtaggagacagagtcaccatctcgtgccgggnaagtcagngctatagactaactttaaatggtatcgaggacgggaaaccaggaaacncccctaaactcctagatctatactgactatacctaatttggactaaaggtcggggtacccatacgaaggttcaggtggaacagtgatcgagggatgtattcactctcacatcagctacgtctagacctaaccgttggtaggttacttttagaaccttaaacttaaccgttacgtacgttaaccgtaagtaaccgggttacctaacccggttaaccccgttacgttacggtttccggaccggtaacggggtaacccttaagggcccttaggggaacgtaacgttaaccgaaaaccggttacgtaacggtcggtccttcggacccttactctttaaccgttccg

SEQ ID NO: 331167 - DNA, 553 bp, Homo sapiens
  misc_feature: GZ8MTXP01BGEPN.17.57.F02.1.454.CMB.2.raw
  modified_base (227)..(227): a, c, t, g, unknown or other
  misc_feature (227)..(227): n is a, c, g, or t
  modified_base (405)..(405): a, c, t, g, unknown or other
  misc_feature (405)..(405): n is a, c, g, or t
  modified_base (543)..(543): a, c, t, g, unknown or other
  misc_feature (543)..(543): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttggccgggnaagtcagagcattagctaaactttaaatggtatcaggacgggaaaccgagggaaacgacccctaaactcctagatctatactgacatcctaatttgacaaaggtcggggtacccagtactaaggttcagtggacaggtgatcgtagggactagtacttcactctcacatcagcagtcngacactgtacgtatttcgacgtaacttacgtactacgttacaacgtaggttacacgttacccgtatacgtttcggccgaagggaccagcgttagggaactacgttacgaaacgttactggtcgaacgtcgaccacgtnttcgttaacg

SEQ ID NO: 331168 - DNA, 618 bp, Homo sapiens
  misc_feature: GZ8MTXP01ALW9E.17.57.F02.1.454.CMB.2.raw
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (447)..(447): a, c, t, g, unknown or other
  misc_feature (447)..(447): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacccgacttaaaccgggacaaccgtcgcccggcaacatacgccttctcccgtcccccttgcagtaacacaagtacagaatataacctgttccatcgactacgccttcggcctcgcttagggccactcaccctgccccgattacgtgacacggtacctggtctcggngagcggtctttcgcctnttctcgttactactgtcngtctagttcnctaacttcngtactaccctcagtcatccgacctcacacgccactacccttnaccaggtcttaacacgaaccctcccgttaccccaaaccgaaactaccactaacgtaccgccgttccgcgtccgccgactcgtccttaacggtcgttactcggtttaccgggttccgtcccctttagccttcccgttcccgattccgtctacggaccttaaggttccaacgg

SEQ ID NO: 331169 - DNA, 613 bp, Homo sapiens
  misc_feature: GZ8MTXP01C6VLS.17.57.F02.1.454.CMB.2.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (232)..(233): a, c, t, g, unknown or other
  misc_feature (232)..(233): n is a, c, g, or t
  modified_base (253)..(253): a, c, t, g, unknown or other
  misc_feature (253)..(253): n is a, c, g, or t
tcagcgtagactagcacgaccggtgctcgatttagctcgatatagttggggtttggggggcaggagtcagtctcagtcaggacacagcatggacatgagggtccccgctcagctcctggggctcctgctactctggctccgaggtgccagatgtgacatccagatgacccagtcctccatccctcctgtctgcatctgtagganacagatcacntctctgcggnaagtcagnntatagacttaattaatgtangaggacggaaacaggaacaccctaaatcctagactctaatactgactactactaagtttgaacgtaaaggtcggtacctagtacgtaaagttcgagtcggtaacgtaggtggtacgtcggtaaaggggtactagtactttaccaccgtacctaccaacctataccagtactaagttagtaccgaacgtaaaccgtaggtaacgtttaactttacggaacttaactttaacgtaacgtacgtaacgtaaacgtacggttaaccgtaccgttaccctaagttacgttcggaacggtaacggacaggtcgagtaacgaacaacgaacgttagtgacgtcgtacgaccacgtaacttcgttaac

SEQ ID NO: 331170 - DNA, 689 bp, Homo sapiens
  misc_feature: GZ8MTXP01DA04S.17.57.F02.1.454.CMB.2.raw
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggananagntcacatctctgccgganaagtcagancaattagtacttaaactttaagnggtatcgacggaccgggtaaaccaagggaaacctaccccgtaaactccgtatactacctaatactgactaacttactaagtttcgaactaaagggtcggtaccctaatacggtaaagttcgaaggtcggaactaggtcggaacttcgggtaagggtactaacgttactttaccaccttactaccaaccgttacacgacgtactagtcgtacgaactaaccggtagtaagttaagtttaccgtaactttaacgtacgttagtaaaccgtaacgtaaccgggttacccaccggtttaaaccccgttgttaccggttaccggaccggaaacgggtaaaccctagggttaccgtaagttaacgtaaacgtacgttaaaaacgttcggttacgaacggtccgtaacgacctaaccgttactttcggttctttaacccc

SEQ ID NO: 331171 - DNA, 650 bp, Homo sapiens
  misc_feature: GZ8MTXP01CA1PK.17.57.F02.1.454.CMB.2.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
tcagcgtagactagcacgaccggtgctcgatttagctcgatatagttggggtttgggggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcacctatctcgttggccggganaagtcagagactattagtacttaaactttttaatggtatcgaggaccgggaacgaagggaaacctacccctaaactcctagactctaatactgctatacctaatttcgacgtaaaggtcggtaccagtacgtaacggttcgaggtggacgtaggtacgggtattcgggtacgggtaactaggttactttacaccttactacccactactcgagtacctagtccttagaaccctaacgtggtaaggttacttttacgaacttaaacgtttactacgttacggtaaccgtaaacgttacggttaccgtaacccgttaaccgttacttaccggtttacggaccggaacgggtactaaggcgttagggaacttacgtaaacgaacgttacgttggacggtcagtccactgttactcgttcttaacc

SEQ ID NO: 331172 - DNA, 504 bp, Homo sapiens
  misc_feature: GZ8MTXP01EPCAY.17.57.F02.1.454.CMB.2.raw
  modified_base (226)..(226): a, c, t, g, unknown or other
  misc_feature (226)..(226): n is a, c, g, or t
  modified_base (277)..(277): a, c, t, g, unknown or other
  misc_feature (277)..(277): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcatagctaactttaaatggtatcagcgggaaccagggaaacncccctaaactcctgatctatactgacatcctaatttgacaaagtcggggtccatcaagtcgagtgacagtggatcgtgggacagattcactctcaccatcagcagtctgcactgagtatttgctaacttatactgtacaacgtaggttacacgtaccccgtatacgttttcggcgtaacgggtacagcttggacgattacgaagaactgagctgcactaagttctcg

SEQ ID NO: 331173 - DNA, 558 bp, Homo sapiens
  misc_feature: GZ8MTXP01ADJBQ.17.57.F02.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
tcagcgtagactagcacgaccggtgctcgatttagctcgatataggttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatctctgccggnaagtcaganctattagactaattttaatgatcagacggacaggaacncccctaactctgatctatctgcactactaatttgacgtaaaggtcgggtaccagtacgtaacggttccaggtggacaggtacgggacttcggagggaactagtactttccacttctaccacctatcaagtcaagtctgactacgtagtagttattgacttaacgtactatgtacaacgtagtaccacgttacccgtatcgttcggacgtacgggcaagcgttaggacacgtaacaaacgggttcttgggttcggaacttacgaaccactacgttcttcgttccttaaccg

SEQ ID NO: 331174 - DNA, 662 bp, Homo sapiens
  misc_feature: GZ8MTXP01B8FFJ.17.57.F02.1.454.CMB.2.raw
  modified_base (234)..(234): a, c, t, g, unknown or other
  misc_feature (234)..(234): n is a, c, g, or t
  modified_base (381)..(381): a, c, t, g, unknown or other
  misc_feature (381)..(381): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtcctccatccctccctgtctgcatctgtaaggagacagacgtccactactcttcgtcgccgggtanaagtcagacgctaattagtacttaaactttttaaagttggtactcgacggaccgggaaaccgaagggaaacctacccctaaactcctagtatctatactgactactactatttggaactaaggtccgggtaccagtacgtacggttnaggtgcaggtacgatcggtgggactaggtacttcgactacgccctaaccgataccgagctacgttactacggacctaacgtcgtaagttactttacgacttaaccgtttactaacgttacgtaaccgtaacggttaacgttaacccgtaccgttacccgttacctacggtttcgggacccggtaacgggacccgtaagccgttaggaacttacgtaaaccggaaacgttacgttcgggctaaccgtcgaaccctaccgtattccgtcgttaaccctttccc

SEQ ID NO: 331175 - DNA, 632 bp, Homo sapiens
  misc_feature: GZ8MTXP01CIHG6.17.57.F02.1.454.CMB.2.raw
  modified_base (231)..(231): a, c, t, g, unknown or other
  misc_feature (231)..(231): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccactccctccctgtctgcatctgtagagacagagtcaccatctcgtcggccgganaagtcagagctattagacttaaatttaatgtatacgaggacgggaaaccaagggaaaccacccctaaactcctagtactctatactgactactactaagttcgaacgtaacggtcggtaccacgtacgtaaggtcaggtcggaactaggtggtactcggtagggactagtactttcaccttaccacctaccatcacgtactacgtcgtacgacctaacgttgtaaggttactttacgacttaaacttacgtacgttacgtaacgtaaccgttacggtaacctacccgttacccgttacgttcgttacggacggtaacgggacgaggtaccaggtaacgtattaaccgttaaacgttacgttgggtaccgtcggtacaccttaccgtaactttcgttaaccg

SEQ ID NO: 331176 - DNA, 611 bp, Homo sapiens
  misc_feature: GZ8MTXP01DJRUD.17.57.F02.1.454.CMB.2.raw
  modified_base (226)..(226): a, c, t, g, unknown or other
  misc_feature (226)..(226): n is a, c, g, or t
  modified_base (412)..(412): a, c, t, g, unknown or other
  misc_feature (412)..(412): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcacatctcttgccgggnaagtcagagctattagactaaactttaatggtatcgaggacgggaaaccagggaaacacccctaaatcctagactctaatactagctaatacctaaagtttgacgtaaaggtcgggtaccctaatacgaaggtttcaagtggaactagtggatcgtagggactagtactttacactctacacctancaagcagtctacgactaacctgtaagtatttagaactaactttaactacgtacgtacctaaacgtacgggttactaaccggtaccccgttagtaccgtttcgggaaccgtaacgggggaaacccaagggtccttagggaaacgtaacttaaccgaaaacgacgttggaacggtctcggacttaccctaagttcttaacg

SEQ ID NO: 331177 - DNA, 664 bp, Homo sapiens
  misc_feature: GZ8MTXP01B7W8O.17.57.F02.1.454.CMB.2.raw
  modified_base (228)..(228): a, c, t, g, unknown or other
  misc_feature (228)..(228): n is a, c, g, or t
  modified_base (645)..(645): a, c, t, g, unknown or other
  misc_feature (645)..(645): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaaccatctcgttggccggganaagtcagagactattagacttaaactttttaaatggtatcgaaggcgggaaaccgaagggaaacacccctaaactctagactactatactacgactactacctaagtttgacgtaaaggttcgggtacccagtacgtaaacggttcaaggtcgcgagtggactcggtggaactagtacttcactctacacctatacacgactacgttacacggtaacctaaccgtaggaagttacttttacggaaacctttaaacctttaccgttaacgtttaaggtaaaccctaaacgggttaaccggttaacctaaccccgggttaaccccttaaccgtttacgtttacggggacccgtaacggggaccaaacggcgttaggaacttagtaaacgtaaacttacgttggactcgacaaccacctnttacgtcgtttcgtaaccc

SEQ ID NO: 331178 - DNA, 717 bp, Homo sapiens
  misc_feature: GZ8MTXP01C4WD5.17.57.F02.1.454.CMB.2.raw
  modified_base (225)..(225): a, c, t, g, unknown or other
  misc_feature (225)..(225): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctctcggccggnaagtcagagctattagacttaactttaatggtatcgaggacggaaaccagggaacacccctaaatcctagtatctaatactgactacttacctaagtttcgaacgtaaacggtcggggtacccctaagtaccgtaaagggttctaagggtcggtaaccgtagggtcgggacttccgggtaggggtactagttactttaccaccttcctacctaacctacgtacacgtacgacgttactacgtacctaagttcgtaggttaacgggtttacttttacggggtaacttaaaccgtttaacctaacgttacggttaaccgtaaaccggttaacggggtttaaccctaacccgttaacccccggtttaagttaacccggttttcgggaacccggtaacgggggaaccctaaacggttccgttaaagggacggttaaaccttaaaccgaaaacggtaaccgttgggtcggtacctcgacctaacccttaagtttccg

SEQ ID NO: 331179 - DNA, 612 bp, Homo sapiens
  misc_feature: GZ8MTXP01EVANE.17.57.F02.1.454.CMB.2.raw
  modified_base (229)..(229): a, c, t, g, unknown or other
  misc_feature (229)..(229): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgatatccagatcgacccagtcctccatccctccctgtctgcatctggtaggagacagatcaccatctcgtggccggnaagtcagagctattagacttaaactttaaagtggtatcgaaggacgggaaaccgaagggaaaccgtacccctaaactcctagactactatactgtacacttacctaatttgactaaaggtcgggtacccagtacgtaaaggttcgagtcggactaggtggactgtgggacagtacttcaactctacacatcaagcgtaacgtctcgacgaactgtaaggttatttcgactaacttactacgtctaaccaaacgtacgggtttaacaaccggttacccgtaacgttacgtttcgggaccgaagggggaacccaaggcgttaaggaacgtaacgttaacgaaacgttaacgtgggtacgcgtacgaccttactcttaaccgttcg

SEQ ID NO: 331180 - DNA, 650 bp, Homo sapiens
  misc_feature: GZ8MTXP01DP4B2.17.57.F02.1.454.CMB.2.raw
  modified_base (461)..(461): a, c, t, g, unknown or other
  misc_feature (461)..(461): n is a, c, g, or t
tcagcgtagactagcacgaccggtgctcgatttagctcgatatagttggggtttgggggggagtcagtctcagtcaggacacagcatggacatgagggtccccgctcagctcctggggctcctgctactctggctccgaggtgccagatgtgacatccagatcgacccagtcctccactccctccctgtctgctatcgtaggtaggagacagacgtccacctatcctcgttcggccgggacaagtcaagacgtactaattagtactttaaaacttttaagtggtactacgacgggaaccgggaaaccgaagggaaacctacccctaaatcctagtactactatactgactacttacctaagtttacgaacgtaagggttccggacctagtacgtaggtcgaggtcgacgtaggtagactcggtaggactagttactacactctacactatcagtctacgtnactactacgtgacgttacttacacttaacttacgtacgtcgtaacgaacgttacggtaacctacccgttacccgtaacgttcgttacgggacccggtaagggtaccaaggtcgaggaaacgttacgtaaacgtaacgttacgttcgggactaacgactaactacctattccgttaacgttcctttaacc

SEQ ID NO: 331181 - DNA, 724 bp, Homo sapiens
  misc_feature: GZ8MTXP01EG0CZ.17.57.F02.1.454.CMB.2.raw
  modified_base (343)..(343): a, c, t, g, unknown or other
  misc_feature (343)..(343): n is a, c, g, or t
tcagcgtagactagcacgaccggtgctcgatttagctcgatataggttggggtttgggggggagtcagtctcagtcaggacacagcatggacatgagggtccccgctcagctcctggggctcctgctactctggctccgaggtgccagatgtgacatccagatcgacccagtcctccatccctccctgtctgactatctggtaggagacagactcacctatctcgttcggccgggactaagtcgaagtagctagttagaccttaaatttttaaagttcggtaatcgaggaccgggaaaaccaggggtaaaccaccccttaaactccgtatatcctaatacctnactacgtactagtttacgacgtaacggtcggtacctagtacgtaacggtcgtaggtcgacgtaggtaacgtagtcggtacggtaactacgttacttaccgacttctacctaccgtactacgacgtactacgtacgtacgtaccgtaacgtaggtaacgttacttacgtaacttaaccgtttaacgtacgttaacgtaaccgtaaacgggtaaccgggttaaacccgtacccggttaacccgttacgttaccgggttaccgggaaccgggtaccgggtaacgtaacggtcggttaaacggtaagttaaccgtaaaccgtaaacggttaacgttcggttacggtcgtcgtaaccgtacgtacgttcgttccgttcgttaaccg

SEQ ID NO: 331182 - DNA, 801 bp, Homo sapiens
  misc_feature: GZ8MTXP01CTZGN.17.57.F02.1.454.CMB.2.raw
  modified_base (210)..(210): a, c, t, g, unknown or other
  misc_feature (210)..(210): n is a, c, g, or t
tcagcgtagactagcacgaccggtgctcgatttagctcgatatagttggggtttgggggcaggagtcagtctcagtcaggacacagcatggacatgagggtccccgctcagctcctggggctcctgctactctggctccgaggtgccagatgtgacatccagatcgacccagtcctccatccctccctgtctgctatcgtaggtaagganaacaggtacgtccaacctattcctcgttcgggacccgggactaagtcgaagtacgactaatttaagtactttaaacttttaaagtggttaactacggaacgggaaccgggaaaccgtaacggggtaaaaccctacccccgttaaaacctccgtagtacttacttaaacttacgtacgtactaacttaaccctaagtttacggaacgtaaacgggtccgggtacccaagtaccgtaaggtcgtaaggtcggtaactagggtggactacgggtagggactagtacttcgacctacgtacaccgtatacgacgaccgtaggtccttacgacgttaaccgtagggttaacgtttaaccgtttacgtaaacctttaacccgtttaacgttaaccggtacgttaaaccgtaaaccggttacccggtttaaccgtaaacccggtttaacccgttaaccgttaaccggggtttaccgggaacccgggtaaacgggtaaacgaaggtaccgttaaaggggtaaacctaacgttaaaccggttaaaccgtttaggcgggttaaccgcggttacaccgttaccgttaacttcgtttaacccg

SEQ ID NO: 331183 - DNA, 648 bp, Homo sapiens
  misc_feature: GZ8MTXP01CLQ9D.17.57.F02.1.454.CMB.2.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtctccatccctcctgtctgcatctgtagganacagatcacatctctgccggganaagtcaganctattagacttaaacttttaatggtatacgaggacgggaaccgaacgggaaaccgtacccctaaactcctagtactactactactcgactactacctaagtttacgacgtaaacggtcgggtacctagtacgtaacggttcgaggtcggactaggtacggtatcggtagggtactagttactttaccacttctacacctatacgacgctacggtctacggaccgtaactagggtacgttactttcggaaccttaactttacgtacttacgtaaccgtaaacggtacggttaacctaccgttaacccgtacgttacgttccgggacggtaacgggaactaaggtcggaggtaaacgacgtaaaccgaacgttacgttcggacggtcacgaactactcgttacttcgttaaccttaacc

SEQ ID NO: 331184 - DNA, 688 bp, Homo sapiens
  misc_feature: GZ8MTXP01CLKFM.17.57.F02.1.454.CMB.2.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (630)..(630): a, c, t, g, unknown or other
  misc_feature (630)..(630): n is a, c, g, or t
  modified_base (659)..(659): a, c, t, g, unknown or other
  misc_feature (659)..(659): n is a, c, g, or t
  modified_base (670)..(670): a, c, t, g, unknown or other
  misc_feature (670)..(670): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacctatctcgttggccgganaagtcagagactattacgtacttaaacttttaaatggtatacgaggaccgggaaaccgaaggggaaacctacccctaaaacttcctagtaactactaactacgtcgactaacttacctaaattttacggaccgtaaaggggttccgggtaccctaagttacggtaaacggtttcgaaggtcgggactacgggtaagggtacgttcggtacggggaactacgttactttccaacttctaccacctactacgacgtcgtaacgtcgtacggacctaacgtgtaacggttacttttacgacttaacctttactacgttacgtaaccgtaacgtacgggttaacctaccggttaaccccgtacgttacgtttccgggaccgtaacgggaactaaggtcgagggtaanacgtaaacgaacgttacgttggttcggcncgtaacacgtnttacctgttccttaaccg

SEQ ID NO: 331185 - DNA, 708 bp, Homo sapiens
  misc_feature: GZ8MTXP01AUCXO.17.57.F02.1.454.CMB.2.raw
  modified_base (233)..(233): a, c, t, g, unknown or other
  misc_feature (233)..(233): n is a, c, g, or t
tcagcgtagactagcacgaccggtgctcgatttagctcgatatagttggggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctgtaaggagacagagtccaccatctcttggccggganaagtcaagagcattagacttaaactttaaagtggtatcgaaggacgggaaaccaaggggaaacacccctaaactcctagatactatactgacactacctaaatttgaacgtaaaggtcggggtacccaagtacgtaaaggttcacggtggaacaggtggaatcgtagggacagtacttacactcctacaccatacgaacgcgtacgtcgtagaccgtaaccgtaggtacggttagtttttaagaccgttaaactttaccgttaacgtacggttaaccgaaacgttaacggggttaaacctaacccgggttaaacccccgttaaccgttaccgttttacggggaacccggtaaaccgggggaaacccttaaagggtccgttaaaggggaaactaaacgttaaacccgttaaaaccgaaaggtttaaccggggtacggtaaccgtaccgaccgttaccgttaacgttcccgttaacg

SEQ ID NO: 331186 - DNA, 722 bp, Homo sapiens
  misc_feature: GZ8MTXP01ANTW2.17.57.F02.1.454.CMB.2.raw
  modified_base (173)..(173): a, c, t, g, unknown or other
  misc_feature (173)..(173): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcnccatccctccctgtctgcatctggtagagacagagtccaccatctcgtcggccggacaagtcaagacgctaagttacgtacttaaacgttttaagtacggtacttacgaggaccggggaaacccgaaggggtaaaaccctaacccccgttaaaaccttcccgtagaacttacttaacgtactagtactacttaccgtaaatttcgaacgtaaggtcgggtacctagtacgtaggtcaggtgaacgtagtggtatacggtacgggatagtacttacactaccctcaacctagacacgtccgtactcgtacgtaccgaccgttagtacggttactttacgaaaccgttaacgtttaaccgtaacgttaccgtaaccgttaaacgggtccggtttaaactaccggtttaccccgtacggtttacccggttaccgggaaccggtaacggggtaaccgttacggtacccggttaaggaaccggtaacttaaccggaaaacccggttgttcggacggtcccttaccggacccttaacgtccgttaacgtttcccg

SEQ ID NO: 331187 - DNA, 729 bp, Homo sapiens
  misc_feature: GZ8MTXP01C215X.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtccaccatctcgtggccggcaagtcagagcattagactaaatttaatggtatcgaggaccgggaaaccagggaaacacccctaaactcctagtactctaatactgactacttacctaagtttcgacgtaaacggtcggggtacccctagtaccgtaaaggtttcgaaggtcggtaactaggtgggtacttaccgggtacggggtaacgtaagttacttttaccgaaccttacccttaccaaccctacgttccaaaaaacggtcccgtaacggttccttacggaacccgtaaacccgttacggtaagggtttacttttacggtaacctttaaaccgtttaaccttaaccgttacgtaaccgtaaaccggtaacgggttaaccgtaacccgttaaccccgttaccgttaaccgtttcgggacccggtaacggggaaccaacggtacgttagggaacgtaacgttaaccgaaacgttaaccgttggtacggtctacggtaccttacctaacttaaccgtttcg

SEQ ID NO: 331188 - DNA, 568 bp, Homo sapiens
  misc_feature: GZ8MTXP01BAMLQ.17.57.F02.1.454.CMB.2.raw
  modified_base (200)..(200): a, c, t, g, unknown or other
  misc_feature (200)..(200): n is a, c, g, or t
  modified_base (275)..(275): a, c, t, g, unknown or other
  misc_feature (275)..(275): n is a, c, g, or t
  modified_base (447)..(447): a, c, t, g, unknown or other
  misc_feature (447)..(447): n is a, c, g, or t
  modified_base (519)..(519): a, c, t, g, unknown or other
  misc_feature (519)..(519): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctctgccgggcaagtcagagcattagactaattttaatggatcaggacggaacagggaaacncccctaaactcctgactctaatactgacacgtacctaaatttcgaacgtaaaggttcggggtacccaagtacgtaacgggtttcgaggtggaccgtaggtagggtactcgtaggggactagtacttttaccactctacacctatcaaggctagtctacgacacgtgaagttntttcacttaacttacactgtaccaagtacggtacaccgtaccgtatcgttcggcgagggcaaggcttagganataacgaacgttacgttggngctcgaacnccgtattcgttcgttctaac

SEQ ID NO: 331189 - DNA, 608 bp, Homo sapiens
  misc_feature: GZ8MTXP01DWLK9.17.57.F02.1.454.CMB.2.raw
  modified_base (458)..(458): a, c, t, g, unknown or other
  misc_feature (458)..(458): n is a, c, g, or t
  modified_base (599)..(599): a, c, t, g, unknown or other
  misc_feature (599)..(599): n is a, c, g, or t
tcagcgtagactagcacgaccggtgctcgatttagctcgatatagttggggtttgggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctcgttgccgggacaagtcagagctaattagacttaaacttttaaatggtatcgaaggaccgggaaaccaagggaaaccacccctaaactcctagatactaatactgacaacttacctaaatttcgaacgtaaaggttcgggtacccagtacgtaacggttcaggtgcgtaggtagggactcggtagggaacagttactttcacttctacactagtcagctacgtctacgacctaacgtgaagttntttacaacttaacttacgtaactcgtaacgaaacgtacggttaaccacgttacccgttacgttacgttcggaccgagggtacaacgtcgaggtaacgactaacgaaacgttagttggttacgctagcctaagtcttccgtntttccgtcc

SEQ ID NO: 331190 - DNA, 584 bp, Homo sapiens
  misc_feature: GZ8MTXP01CGEJW.17.57.F02.1.454.CMB.2.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaganacagagtcacatctctgccggcaagtcagancattagacttaaactttttaatggatcgaggacggaaccagggaaacacccctaaactcctagactctatactgactactacctaatttgacgtaaaggttcgggtacccagtacgtaacggttcagtggcaggtcggatcgagggaactagtactttcacgtctaccaccatacgagactagttctagacctaacgtgtaggttactttacgacttaaacttactacgttacgtaacctaacggtacggttacctaccgttacccgtacgttacgtttcgggaccgtaagggaccaagtcgttaggacactacgaacgttacgttgttcgctgctactgttcttgttccttaacg

SEQ ID NO: 331191 - DNA, 702 bp, Homo sapiens
  misc_feature: GZ8MTXP01A71HH.17.57.F02.1.454.CMB.2.raw
  modified_base (238)..(238): a, c, t, g, unknown or other
  misc_feature (238)..(238): n is a, c, g, or t
tcagcgtagactagcacgaccggtgctcgatttagctcgatatagttgggtttgggggcaggagtcagtctcagtcaggacacagcatggacatggagggtccccgctcagctcctggggctcctgctactctggctccgaggtgccagatgtgacatccagatcgacccagtcctccactccctccctgtctgcatctggtaaggagacagacgtccacctatctcgtcggccgganaagtacagagactaagttacgtacttaaactttaaagtggtaactacgaacggaccgggaaaccgaacggaaacctacccctaaactctagacttactaatactcgactactacctaagttcgaacgtaaggtccggtacctagtacgtaaggttcgaaggtcggtaacgtagggtggtacttcgggtaacgggaactagttacttaccgtaccttcctaacctaacctacgtacgtacgtaccgtaacgttaccgtacgtaaccgtaacggttacggtaacgttacgtttacaaccgttaacttactaccgtacgtaacgtaaccgtacggttaacctaacccgttacccgtacgttaccgttacggaccggtaagggaaccgagtcgttagtaacgtaacgttaaccgttaaacggttacgtcggtcgtaacgacgtaccttacctaacgttcgttaacccg

SEQ ID NO: 331192 - DNA, 709 bp, Homo sapiens
  misc_feature: GZ8MTXP01CCO55.17.57.F02.1.454.CMB.2.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccactccctccctgtctgcatctaggtagganacagacgtccacctatctcgttcggccggacaagtcaganactattagtacttaatttaagtgtatacgacggacggaaaccgaacggaaacctacccctaaacgtctagacttacgtaactacgtcgtactacttaaccctaagttacgaacgtaacgggtcggtacctaagttacggtaaggttcgaaggtcggaacgtacggtggacgttacgggtacgggactacgttacttacctaccttcctacgaacctataccgacgtacgtacgtccgtacgtaacctaaccggttagtaacggtttactttacggaaaccttaacgtttaaccgtacgttaacgtaaacccgtaacggttaccggttaaccgttaacccggttaccccgttaacgttaccggtttaccgggaaccggtaaacggtaaccgagtacgaacggtaacgtaacaaacgttaacgttgtcggtagtccgtcaccttacgttaaccttcggttaacc

SEQ ID NO: 331193 - DNA, 690 bp, Homo sapiens
  misc_feature: GZ8MTXP01D0GH5.17.57.F02.1.454.CMB.2.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgctatctagtagganacagatccacctatctcgttggccggganaagtcaagagctaattagacttaaactttaaatggtatacgagacgggaaaccaaggaaaccgacccctaaactcctagacttctaatactgactactaccgtaattcgacgtaaaggtcgggtaccctatacgtaaggtcaggtgacagtggatcggtgggacagttacttacaccttctacacctatacgacgtctaagttcctacgaccgtaaccgttaggtaacggttaacttttacgaaacgtttaaactttaccgtaacttacggtaaaccgtaaaccggttacggttaaccgttaaacccggtttaaccccgtaacgtttaaccgttttcggggaacccgtaaacggggaacccttaagggtaccgttaagggtaaactaacgttaaacggttaaacgttacggtttaaggcggtaacgtacgtaccttaccttaacttcggtttaaccg

SEQ ID NO: 331194 - DNA, 682 bp, Homo sapiens
  misc_feature: GZ8MTXP01AOR1C.17.57.F02.1.454.CMB.2.raw
  modified_base (436)..(436): a, c, t, g, unknown or other
  misc_feature (436)..(436): n is a, c, g, or t
  modified_base (492)..(492): a, c, t, g, unknown or other
  misc_feature (492)..(492): n is a, c, g, or t
  modified_base (644)..(644): a, c, t, g, unknown or other
  misc_feature (644)..(644): n is a, c, g, or t
tcagcgtagactagcacgaccggtgctcgatttagctcgatatagttggggtttgggggggagtcagtctcagtcaggacacagcatggacatgagggtccccgctcagctcctggggctcctgctactctggctccgaggtgccagatgtgacatccagatcgacccagtcctccactccctccctgtctgctatcgtggtaggagacagagtcaccatctcgttcggccgggacaagtcagagtactattagaccttaaatttttaattggtatacgaggtaccgggaaaccgaaggggaaacctaccccgtaaactcctagtaatctaatacctgactatacctaagtttcgacgtaaacgggttcgggtaccagtacgtaacggttacaggtcggacgtaggtaaggacgttcgagggtactagtacttccnctactaccgactactcgagtctaagtcgtacggacctaaccggttggaaacgtttntttaaccggaacctttaaccgtttaaccgtacgttacggttaaacccaaacggttacggggttaaccctaccggttaaccccggtacgttacggtttcgggacccggtaacgggacctaaggcgttagggaattaacgtaacaaacgttcgngggactctagaaccctcgacttcgttcgttccctaacg

SEQ ID NO: 331195 - DNA, 666 bp, Homo sapiens
  misc_feature: GZ8MTXP01DJKZH.17.57.F02.1.454.CMB.2.raw
  modified_base (232)..(232): a, c, t, g, unknown or other
  misc_feature (232)..(232): n is a, c, g, or t
  modified_base (462)..(462): a, c, t, g, unknown or other
  misc_feature (462)..(462): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatctcgttggcccgggtaanaagtcagagtactaagttaacgtaactttaaaacgtttaaagtaggtaactacgaacggaaccgggaaaccgaaacggaaacctaacccctaaactcctagtactactaactactcgtactaactaacctaagttacgaacgtaaacggtcggtacctaagtacggtaaggtcgaggtggaacgtaggtggtacgtaggtacggaactagtacttacactactacaccanacacgacgtacgtacgtacgtacgtaacgtagtaagttattacgtaacgtaacttaacttaacgtacgtaacgtaacgtaacgtaacgtaaccgtacccgtaccgtacgttacggtaccggaacggaacgaacgtacgttaacgtaagtaacgttaacgaaacgttaacgtaacgtacgtcgtacgtacactaacgttcgttcg

SEQ ID NO: 331196 - DNA, 705 bp, Homo sapiens
  misc_feature: GZ8MTXP01AQ1BJ.17.57.F02.1.454.CMB.2.raw
  modified_base (205)..(205): a, c, t, g, unknown or other
  misc_feature (205)..(205): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccatccctccctgtctgcatctggtagganacagacgtaccacctatcctcgttcggacccgggtacaagtcaagagtactaattagtacttaaaacttttaaatgggttaatccgaagggaccgggaaacccgaaggggtaaaccgtacccccgtaaaacctccgtagtaacttactaacttaactcgactactaccctaagtttcgaacgtaaacgggtcggggtacccaagttacggtaacgggttaccgaggtcggaactagggtgtactcgggtagggactaggttacttaccgtaccttcctactaccgacttcgaacgctagtccgtacgaacctaaccgttaggtaacggtttactttacggaacttaacgtttactacgtacgttaaccaacgttaacggtaactaacccggttaccctaacgttaccggttacggaccgtaagggtaaccaggacgttcgaaagtaacttacggaaacgttcgtaacggtacggctacggtaccaaccgttgttccgtcg

SEQ ID NO: 331197 - DNA, 677 bp, Homo sapiens
  misc_feature: GZ8MTXP01EV3LT.17.57.F02.1.454.CMB.2.raw
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatctcttgccgggacaagtcaagagacattagacttaaactttttaaatggtactcgaggtaccgggaaaccgagggaaaccacccctaaactcctagactctaatactcgactactactaagtttcgacgtaaaggtcgggtacccagtacgtaacggttcaggtcggactaggtcgtaagtcgtagggactagtactttaccacttcgtacacctatcgagctacgtcgtacgacctaacgtggaagttctttacgacttaacttaccgtactttacggtaacctaacggtaccggttaccaacccggtttaccccttaacgttaccggtttaccgggaccggttaaccggggacctaagtccggttagggtaacgttaaccgttaacgaaaaccggttcgttcgggttacggtccggtaacctccgtaaaccctagtttaccttccggttttcccttaacccg

SEQ ID NO: 331198 - DNA, 739 bp, Homo sapiens
  misc_feature: GZ8MTXP01EYNRM.17.57.F02.1.454.CMB.2.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (241)..(241): a, c, t, g, unknown or other
  misc_feature (241)..(241): n is a, c, g, or t
  modified_base (687)..(687): a, c, t, g, unknown or other
  misc_feature (687)..(687): n is a, c, g, or t
tcagcgtagactagcacgaccggtgctcgatttagctcgatatagttggggtttgggggggagtcagtctcagtcaggacacagcatggacatgagggtccccgctcagctccgtgggggcctcctgctactctggctccggaggtgccagatgtgacatccagatcgacccagtcctccactcccttccctgtctgctatcagtagganacagntccacctatccttctcgggccggganaagtcagtagacttaattacgactttaaaactttttaagtggtactacgagggaccgggaaccgaaaggggaaaccctaccccctaaacttccgtagtactctaactacgtcgactactacctaaagtttcggaacgtaaagggggttccgggtacctacgttaacggtaacgggttcagggtcggacgtaggtaaggtacttcggagggtaccattctttccaccttaccaacttacaaccacgtcgtaacgcctagtacccgaactttaggtacgggaaacctttttttggaccgaaactttttcgtaacccaacggtttaccctaaaccacgggggttttaccccaaacgtttacccccgggggtttaacccaacgtttttacccggggtaccccaagggggttaccgaaacgtaacgggtcggaaaggacttcgaaaacggnaaacgttcgttacggaaccgtacgtccgtccgtacttacctccgttcgttcc

SEQ ID NO: 331199 - DNA, 587 bp, Homo sapiens
  misc_feature: GZ8MTXP01DCCHY.17.57.F02.1.454.CMB.2.raw
  modified_base (199)..(199): a, c, t, g, unknown or other
  misc_feature (199)..(199): n is a, c, g, or t
  modified_base (473)..(473): a, c, t, g, unknown or other
  misc_feature (473)..(473): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtcctccatcctccctgtctgcatctgtaganacagatcacatctctgccggacaagtcagagacattagacttaaacttttaaatgtatacgaggacggaaaccgaagggaaaccgtacccctaaatccctagactctatactgactactacctaatttgacgtaaggtcggtaccagtacgtaaggtcaggtgacaggtgatcgtagggactagtacttaccactactaccacctatcagctagtaccgtagactaaccgtgaagttattacgactaacttactactggtaacacgtacgtacnccgttacctacgtcgttcggacgaggaccaagtcgttaggaacttagtaaaccgaacgttaacgttcggttacgggtctacgaacctacttagttccgttcgttccgttaaccc

SEQ ID NO: 331200 - DNA, 639 bp, Homo sapiens
  misc_feature: GZ8MTXP01AZ3JT.17.57.F02.1.454.CMB.2.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (452)..(452): a, c, t, g, unknown or other
  misc_feature (452)..(452): n is a, c, g, or t
tcagcgtagactagcacgaccggtgctcgatttagctcgatatagttgggtttgggggcaggagtcagtctcagtcaggacacagcatggacatgagggtccccgctcagctcctggggcctcctgctactctggctccgaggtgccagatgtgacatccagatgacccagtctccatcctccctgtctgcatctgtagganacagatcacatctctcggccggnaagtcagagctattagacttaaattaatgtatacgaggacggaaaccaagggaaaccaccccgtaaactccgtagtactactatactgactacttaccctaagtttacgaacgtaaaggtccgggtacccctaagtaccgtaaggttccgaaggtcggaacgtaggtggagtccgtaggggaactagttacttactacctcctacaactactacgacgctacgtccngtaaccaaccgttgtaaggttatttacgacttaaacttactacgtacgtactaacggtacgttaactaaccgtacccgtagttaccgttcggacggtaacgggacaggtcgttagaacgtaacttaacgaaaccggttaagtcggtaggtaaccctacggtaccttacctaacgttccctttaaccg

SEQ ID NO: 331201 - DNA, 617 bp, Homo sapiens
  misc_feature: GZ8MTXP01BTESN.17.57.F02.1.454.CMB.2.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcgtggccggcaagtcagagctattagacttaaactttaatggtatcgaggacgggaaaccagggaaacncccctaaactcctagatactatactgacacttcctaatttgactaaaggtcgggtaccctagtacgtaaggttcgaggtcggacagggttggacttcggtaggggacctaaggttactttcaacttcctacaccgtatccaagcgtacgtctacgaccaccgttgtaggttactttcgacttaactttacgtactgtaacgaacgttacgggttacctaccgttaccccgtaacgttacgtttacgggccggtaacggggaccaacggtcgttaggaaacgtattaaccgaaacgttagtcggtacgcgtacgacttaccctaagttccgtc

SEQ ID NO: 331202 - DNA, 670 bp, Homo sapiens
  misc_feature: GZ8MTXP01DMCE4.17.57.F02.1.454.CMB.2.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (655)..(655): a, c, t, g, unknown or other
  misc_feature (655)..(655): n is a, c, g, or t
tcagcgtagactagcacgaccggtgctcgatttagctcgatatagttgggtttgggggggagtcagtctcagtcaggacacagcatggacatgagggtccccgctcagctcctggggctcctgctactctggctccgaggtgccagatgtgacatccagatgacccagtcctccatcctcctgtctgcatctgtagganacagagtccaccatctcgttggccggganaaagtcaagacgctaattacgacttaaactttttaaagtggtatacgaacggaccggggaaaccaagggggaaacctacccccttaaactccgtaggtacttctaatacctgtactacttacctaatttcggaacgtaaaggttcgggtacccagtacgtaaacggttcaggtggctaggtagtaactggtacgggacctagttactttcgacttctacacctagtcagactacttcgtacgacctacgtggtaacggttactttacggacttaactttaacgttaacgtacgttaacgaacggttacgggttaacctaccgttaaccccggttacgttaccgtttacgggaccgttacggggaacctaaaggtcgttaggaacgttactaaaccgtaacgttacgttggttacgctagctaccgtnttacgtcgttcgtcg

SEQ ID NO: 331203 - DNA, 520 bp, Homo sapiens
  misc_feature: GZ8MTXP02IQ39X.17.57.F02.1.454.CMB.2.raw
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcgggaaccagggaaacgcccctaaactcctgatctatactgcatccaatttgacaaagtgggtccatcaagttcagtgcagtggatctgggacagatttcactctcaccatcagcagtctgcaactgagtatttgactaactttacactgtacaaacgtaggttaacacgtaccccgtatacgttttggaccctaggggaccctaaggcgtaggaagtacgtacaaaacgactggtcggactcgacctaccattcctcg

SEQ ID NO: 331204 - DNA, 491 bp, Homo sapiens
  misc_feature: GZ8MTXP02GP8RO.17.57.F02.1.454.CMB.2.raw
  modified_base (197)..(197): a, c, t, g, unknown or other
  misc_feature (197)..(197): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaacttttaaatggtatcagcgggaaccaggggaaagcccctaaaactcctagatctatactgcatccaaatttgacaaagtgggtcccatcaaggttcagtggcagtggatctgggacagatttcactctcacatcagcagtctgcaacctgaggatttgacaacttactactgtacaaacaggttacagtacccgtanactttgcaggggctaagctggananacaacgactgngcngacacatctctctc

SEQ ID NO: 331205 - DNA, 502 bp, Homo sapiens
  misc_feature: GZ8MTXP02GDMWN.17.57.F02.1.454.CMB.2.raw
  modified_base (439)..(439): a, c, t, g, unknown or other
  misc_feature (439)..(439): n is a, c, g, or t
tcagcgtagactagcacgaccggtgctcgatttagctcgatatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaacttttaaatggtatcagcggaaccagggaaagcccctaaactcctgatctatactgcatccaatttgacaaagtggggtcccatcaaggttcagtgcagtggatctgggacagatttcactctcaccatcagcagtctgcaacctgagattttgactaacttactaactgttcaaacagggtttaacagttaccccgtanacttttggcctaggggaccaaagctggagatacaaacgactgtaggctgcaccatctgtcttc

SEQ ID NO: 331206 - DNA, 499 bp, Homo sapiens
  misc_feature: GZ8MTXP02FPLOM.17.57.F02.1.454.CMB.2.raw
  modified_base (273)..(273): a, c, t, g, unknown or other
  misc_feature (273)..(273): n is a, c, g, or t
  modified_base (468)..(468): a, c, t, g, unknown or other
  misc_feature (468)..(468): n is a, c, g, or t
  modified_base (494)..(494): a, c, t, g, unknown or other
  misc_feature (494)..(494): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccagggaaancccctaaatcctgatctatactgcatccaatttgcaaagtggggtccatcaaggttcagtgcagtggatctgggacagatttcactctcaccatcagcagtctgcaacctgaggatttgactaaacttactactgtacaacgtagggttacacgttaccccgtatacgtttggacctaggggaccaagctagganatcaaaacgactgtagctgcacatcngtctc

SEQ ID NO: 331207 - DNA, 514 bp, Homo sapiens
  misc_feature: GZ8MTXP02JA5IE.17.57.F02.1.454.CMB.2.raw
  modified_base (275)..(275): a, c, t, g, unknown or other
  misc_feature (275)..(275): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaatggtatcagcggaaccagggaaacncccctaaatcctgatctatactgcatccaatttgacaaagtgggtccatcaagttcagtgcagtgatcgtgggacagtatttcactctcaccatcagcagtctgcaactgagtatttgactaaactttacactgtacaacgtagggttaccacgttacccccgtatacgtttggaccaggggaccaaggctaggacgattaccaaaacgtactgtacggctgctaccattctgtcttac

SEQ ID NO: 331208 - DNA, 511 bp, Homo sapiens
  misc_feature: GZ8MTXP02FVMJS.17.57.F02.1.454.CMB.2.raw
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagactgagtcaccatctcttgccgggcaagtcagagcattagctaaacttttaaatggtatcagcggaaccagggaaacgcccctaaactcctgatctatactgacatccaatttgactaaagtggggtcccatcaaggttcagtggcagtggatcgtgggacagatttcactctcaccatcagcagtctgcaactgagatttgactaacttactactgtacaaacgtagggttacacgttaccccgtatacgtttgccgtacgggacaagctggacgtatacaaacgactgtggaactgcaccatctgtctttac

SEQ ID NO: 331209 - DNA, 531 bp, Homo sapiens
  misc_feature: GZ8MTXP02FSEVM.17.57.F02.1.454.CMB.2.raw
  modified_base (366)..(366): a, c, t, g, unknown or other
  misc_feature (366)..(366): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccagggaaagcccctaaatcctgatctatactgcatccaatttgcaaagtgggtccatcaaggttcagtgcagtggatctgggacagtatttcactctnaccatcagcagtctgctaacctgaggtattttgactaacttactactcgtacaaacgagggtttaacacgttaacccccgtataaccgtttttgggacccagggggacccaaaggcctaggaacgacttaccaaaacgtaactgtcggctacgacaccatcttcg

SEQ ID NO: 331210 - DNA, 503 bp, Homo sapiens
  misc_feature: GZ8MTXP02I9HH7.17.57.F02.1.454.CMB.2.raw
  modified_base (371)..(371): a, c, t, g, unknown or other
  misc_feature (371)..(371): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaacttttaaatggtatcagcggaaccagggaagcccctaaactcctgactctatactgcatccaatttgactaaagtggggtccatcaagttcagtggcagtggatctgggacagatttcactctcaccntcagcagtctcgcacctagagatttagtctacttactactagtacactagtacgtacgtaccgtactacttcgtacgacggacgacgacgtagacggatacaacgaacgtaacgtggactgcacactactcg

SEQ ID NO: 331211 - DNA, 503 bp, Homo sapiens
  misc_feature: GZ8MTXP02F8ZQ6.17.57.F02.1.454.CMB.2.raw
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccagggaaacgcccctaaactcctgatctatactgcatccaatttgcaaagtgggtccatcaagttcagtgcagtgatcgtgggacagatttcactctcacatcagcagtctgcaactgagtatttgactaaacttactactgtacaacgagggttacacgtacccgtatacgtttggccgtaaggggaccaaagcgtaggagactacaaacgactgtagctgactacatctacgtcttc

SEQ ID NO: 331212 - DNA, 513 bp, Homo sapiens
  misc_feature: GZ8MTXP02JKGAV.17.57.F02.1.454.CMB.2.raw
  modified_base (380)..(380): a, c, t, g, unknown or other
  misc_feature (380)..(380): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaatggtatcagcggaacagggaaacgcccctaaactcctgatctatactgcatccaatttgacaaagtgggtccatcaaggttcagtgcagtgatcgtagggacagtatttcactctcaccatcagcagtcngacaactgaggtatttgactaacttactactgtacaagaggttacacgtaccctatacgtttggcaggggaccaaggctaggaagactaacgaaacgaacgtgtacggcctagaccaccatccttgtctttac

SEQ ID NO: 331213 - DNA, 581 bp, Homo sapiens
  misc_feature: GZ8MTXP02JD4VT.17.57.F02.1.454.CMB.2.raw
  modified_base (466)..(466): a, c, t, g, unknown or other
  misc_feature (466)..(466): n is a, c, g, or t
  modified_base (515)..(515): a, c, t, g, unknown or other
  misc_feature (515)..(515): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgccttcggcctcgccttaggggtcgactcaccctgccccgattaacgttggacaggaacccttggtcttccggcgagcgggcttttcacccgtctttatcgttaccttatgtcagcattcgcacttctgatacctcagcatgcctcacagcacaccttcacaggcttacagaaccncctaccccaccaacacgcaatacgcgtcgctcgccgcacgtcgttcggngctagttcggtttaccgtccccgtttcacttcccgttcccgcctacttccgtacgtaccttacgtc

SEQ ID NO: 331214 - DNA, 506 bp, Homo sapiens
  misc_feature: GZ8MTXP02GH65M.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaacttttaaatggtatcagacgggaacaggaaagcccctaaatcctgatctatactgcatccaatttgacaaagtcgggtccatcaagttcagtggcagtggatcgtgggacagtatttcactctcaccatcagcagtctgcaactgagtatttgactacttactactgtacaagtacggttacacgtacccgtatactttcggacctaggggaccaagcgtagggacactacaaacgaactgtcgctacgcacctatcttcg

SEQ ID NO: 331215 - DNA, 518 bp, Homo sapiens
  misc_feature: GZ8MTXP02F6DHX.17.57.F02.1.454.CMB.2.raw
  modified_base (222)..(222): a, c, t, g, unknown or other
  misc_feature (222)..(222): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaacttttaaatggtatcagcggaaccagggaaacgcccctaaactcctagatctatactgcatccaatttgacaaagtgggtccatcaagttcagtgcagtgatcgtgggacagtattcactctcaccatcagcagtctgcaactgagtatttgactaaactttacgactgtaccaaagtagggttaaccagttaaccccgtataactttggaccgaggggaccaaagctagggataactacaaacgaaacgtagtagcgtcgacacaactcttctctc

SEQ ID NO: 331216 - DNA, 510 bp, Homo sapiens
  misc_feature: GZ8MTXP02HJISD.17.57.F02.1.454.CMB.2.raw
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggcaagtcagagcattagctaacttttaaatggtatcagcggaacaggaaacgcccctaaactcctgatctatactgcatccaatttgcaaagtggggtccatcaaggttcagtgcagtggatcgtgggacagatttcactctcaccatcagcagtctgcaactgagtatttcgactaaactttctactgtacaaacgtagggttacacgtacccgtatacgtttggaccgtaggggaccaaggcgtaggacgatacgaaacgactgtaggctcgacactagtcttctactc

SEQ ID NO: 331217 - DNA, 522 bp, Homo sapiens
  misc_feature: GZ8MTXP02FYYW8.17.57.F02.1.454.CMB.2.raw
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaattggtatcagcgggaaccaggaaagcccctaaactcctgatctatactgcatccaatttgacaaagtggggtccatcaagttcagtggcagtggatcgtgggacagtatttcactctcaccatcagcagtctgcaactgaggtattttgactaacttactactagtacaaacgagggttacacgttaccccgtataccgttttggacccaggggtaccaaggctaggagactacgaaacgtaactgtcggactcggactaccatcgttcg

SEQ ID NO: 331218 - DNA, 667 bp, Homo sapiens
  misc_feature: GZ8MTXP02IEO4Y.17.57.F02.1.454.CMB.2.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (308)..(308): a, c, t, g, unknown or other
  misc_feature (308)..(308): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggganacagagtccacatcttcgtcggccgganaagtcagagctattagactttaaattttaagtgtatcgaggacggaacgaaggaaccaccctaactctagactactatacgnactactaccttaagtttgaacgtaaaggtccgggtacctagtaccgtagttacgaggtcgacgtaggtaggacttcggggagggtaactagtttactttacccactttctacccaaaccctactacgacgtacgtacgtcgtacgaacctaacgtaggtaacgttagttacgtaaccttaaaccttactacgttacgtaaacgtaacggttaacggttaaccgtaaccgttaacccgttaacgtttacggtttacggaaccgggtaacggtaacgaacgtacggtaggaacgtaacgtaaacgtaaacgtacgttacggacgtaacgtacgaacctactacttccgttacgttacctac

SEQ ID NO: 331219 - DNA, 544 bp, Homo sapiens
  misc_feature: GZ8MTXP02HC6CE.17.57.F02.1.454.CMB.2.raw
  modified_base (225)..(225): a, c, t, g, unknown or other
  misc_feature (225)..(225): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaacttttaaatggtatcagcggaaccagggaaacgcccctaaactcctagatactatactgactatcctaatttcgactaaaggtcggggtacccagtacaaggttcaggtggacagtggatcgtgggacagtatttcactctcaccatcagctagtctgcaactgagtatttgactaacttacatgactaacgtaggttaacacgtaccctatactttcgggaccctaggggacctaagcgtaggaactacgtaaccgaaacgtaacgtggtacggtacctacgaccacctattacgttcg

SEQ ID NO: 331220 - DNA, 501 bp, Homo sapiens
  misc_feature: GZ8MTXP02F9HY8.17.57.F02.1.454.CMB.2.raw
  modified_base (270)..(270): a, c, t, g, unknown or other
  misc_feature (270)..(270): n is a, c, g, or t
  modified_base (469)..(469): a, c, t, g, unknown or other
  misc_feature (469)..(469): n is a, c, g, or t
  modified_base (497)..(497): a, c, t, g, unknown or other
  misc_feature (497)..(497): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaacaggaancccctaaatcctgatctatactgcatccaatttgactaaagtggggtcccatcaaggttcagtggcagtggatcgtgggacagtatttcactctcaccatcagcagtctgcaactgagtatttgactaaacttactactgtacaacgtagggttaacacgtaccccgtatacgtttggaccaggggaccaagctagganatacaaacgactgtagctgcaccatctntctc

SEQ ID NO: 331221 - DNA, 517 bp, Homo sapiens
  misc_feature: GZ8MTXP02IT34S.17.57.F02.1.454.CMB.2.raw
  modified_base (280)..(280): a, c, t, g, unknown or other
  misc_feature (280)..(280): n is a, c, g, or t
  modified_base (364)..(364): a, c, t, g, unknown or other
  misc_feature (364)..(364): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaactttttaaatggtatcagcgggaaccagggaaacncccctaaatcctgatctatactgcatccaatttgactaaaggtcgggtccatcaagttcagtgcagtggatcgtgggactagtntttcactctacaccatcagcagtctgcaactgagtatttgactaacttactactgtacaacgtaggttacacgtacccgtatacgtttcggaccgtacggggaccaagcgtaggacactacaaacgtactggtacgctcgacacctattctcg

SEQ ID NO: 331222 - DNA, 519 bp, Homo sapiens
  misc_feature: GZ8MTXP02I8CQT.17.57.F02.1.454.CMB.2.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
tcagcgtagactagcacgaccggtgctcgatttagctcgatatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaacttttaaatggtatcagcggaacagggaaancccctaaatcctgatctatactgcatccaatttgacaaagtggggtacccatcaaggttcagtggcagtggatcgtgggacagatttcactctcaccatcagcagtctgcaacctgaggtatttcgactaaacttactacttgtacaacgtagggttaacacgtaccccgtactacgttttcggaccgtaggggaccaaagctaggacgaatacaaacgaactgtagcgtcgacaccatcctgtcttc

SEQ ID NO: 331223 - DNA, 539 bp, Homo sapiens
  misc_feature: GZ8MTXP02G78Y6.17.57.F02.1.454.CMB.2.raw
  modified_base (226)..(226): a, c, t, g, unknown or other
  misc_feature (226)..(226): n is a, c, g, or t
  modified_base (279)..(279): a, c, t, g, unknown or other
  misc_feature (279)..(279): n is a, c, g, or t
  modified_base (533)..(533): a, c, t, g, unknown or other
  misc_feature (533)..(533): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaaacttttaatggtatcagcggaaaccagggaaacncccctaaactcctgatctatactgcatccaatttgacgtaaagtcgggtaccatcgaagttcagtgcagtggatcgtgggacagtatttcactctacaccatcagcagtctagacaaactgacggttattttcgactaactttacactagtaccaaacgtacgggttaacaccgtaccccgtatacgtttcggaccgtaacggggaccaagctagggaactactacgaaacgtactggtacgctgaccaacctntcgtcg

SEQ ID NO: 331224 - DNA, 500 bp, Homo sapiens
  misc_feature: GZ8MTXP02J0O40.17.57.F02.1.454.CMB.2.raw
  modified_base (222)..(222): a, c, t, g, unknown or other
  misc_feature (222)..(222): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaacttttaatggtatcagcggaaccagggaaagcccctaaactcctgatctatactgcatccaatttgacaaagtggggtacccatcaaggttcagtggcagtgatctgggacagattcactctcaccatcagcagtctgcaactgaggtatttgactaacttactactgtacaacgtagggttacacgttaccccgtatactttggcctaggggaccaaggctaggacgatacgaaacgactgtgctgcacatctgtctc

SEQ ID NO: 331225 - DNA, 516 bp, Homo sapiens
  misc_feature: GZ8MTXP02JYQ6T.17.57.F02.1.454.CMB.2.raw
  modified_base (226)..(226): a, c, t, g, unknown or other
  misc_feature (226)..(226): n is a, c, g, or t
  modified_base (386)..(386): a, c, t, g, unknown or other
  misc_feature (386)..(386): n is a, c, g, or t
  modified_base (497)..(497): a, c, t, g, unknown or other
  misc_feature (497)..(497): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagactaacttttaaatggtatcagcggaaccagggaaacgcccctaaactcctgatctatactgcatcctaatttgacaaaggtcggggtacccatcaaggttcagtgcagtgatcgtgggacagtatttcacttctcacctatcancagtctgacaacgtgagttatttcgactaacttacactgtacaacgtaggtacacgtacccctatacgtttgacgtacgggaccaagcgtagacgactacgaaacgatcgngactcgaccacgtatctcg

SEQ ID NO: 331226 - DNA, 536 bp, Homo sapiens
  misc_feature: GZ8MTXP02GMAXA.17.57.F02.1.454.CMB.2.raw
  modified_base (201)..(201): a, c, t, g, unknown or other
  misc_feature (201)..(201): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctgccgggcaagtcagagcattagctaacttttaaatggtatcagcgggaaccagggaaacgcccctaaatcctgatctatactgcatccaatttgactaaaggtcggggtccatcaaggttcagtggcagtggatcgtagggacagtatttcactctcaccatcagcagtctgacaacctgagtatttgactaacttacactgtacaacgtaggttacacgtacccgtactacgtttggaccgtacgggaccaagccgtaggaacgtaacgtaaccaaaacggtaactggtacggtacctacgaccaactacttcttcg

SEQ ID NO: 331227 - DNA, 546 bp, Homo sapiens
  misc_feature: GZ8MTXP02GA7WD.17.57.F02.1.454.CMB.2.raw
  modified_base (493)..(493): a, c, t, g, unknown or other
  misc_feature (493)..(493): n is a, c, g, or t
  modified_base (521)..(521): a, c, t, g, unknown or other
  misc_feature (521)..(521): n is a, c, g, or t
tcagcgtagactagcacgaccggtgctcgatttagctcgatatagttgggtttgggtacgatttgatgttacctgatgcttagaggctttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgccttcggcctcgcctaggggtcactcaccctgccccgattaacgtgacaggaacccttggtcttccggcgagcgggcttttcaccgctttatcgttaccttatgtcagcattcgcacttctgatacctcagcatgccctcacagcacaccttcacaggcttacagaaacgctccccctaccaacaacgcaataagcgtcgctgccncagctcggtgcatcggttacgcccgttnactcttcccgcatcctgacctagtc

SEQ ID NO: 331228 - DNA, 559 bp, Homo sapiens
  misc_feature: GZ8MTXP02G7PQE.17.57.F02.1.454.CMB.2.raw
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaactttttaaattggtatcgaggcgggaaaccagggaaacgcccctaaactcctgatctatactgcatccaatttgactaaaggtcgggtaccatacgaaggttcagtggcagtggatcgtgggacagtatttcactctcaccatcagcagtctgaccaacgtgagtatttgactaacttactacttagtactaacgagggttacacgttaccccgttatacgtttcggaccgtaaggggaaccaagcgtaggaacgtataaccgaaaacgtacttggacggctaggaccctaaacctagtccttcgttactttaaccg

SEQ ID NO: 331229 - DNA, 592 bp, Homo sapiens
  misc_feature: GZ8MTXP02F84UQ.17.57.F02.1.454.CMB.2.raw
  modified_base (383)..(383): a, c, t, g, unknown or other
  misc_feature (383)..(383): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgttggacaggaacccttggtcttccggcgagcgggcttttcacccgntttatcgttaccttatgtcagcattcgcacttctgatacctcagcatgcctcacagcacaccttcacaggcttacagaacgctcccctaccaacaacgcaactaagcgtacgctgccgcacgcttccggtgcctaattcgggttttaacgcccccgttttcaacttccctttcccccggcctaactcctacgtaaccttaaactttccc

SEQ ID NO: 331230 - DNA, 524 bp, Homo sapiens
  misc_feature: GZ8MTXP02G8IHJ.17.57.F02.1.454.CMB.2.raw
  modified_base (381)..(381): a, c, t, g, unknown or other
  misc_feature (381)..(381): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaacaggaaacgcccctaaactcctgatctatactgcatccaatttgacaaagtgggtccatcaaggttcagtgcagtggatctgggacagtatttcactctcaccatcagcagtccngcaactgaggtatttgactaactttactactgtacaaacgtaggttaacacgtacccgtatacgtttcggcctaaggggacccaaagccgtaggaaagactaacgaaacgtaactggtcggactcgaccaacctataccttcg

SEQ ID NO: 331231 - DNA, 574 bp, Homo sapiens
  misc_feature: GZ8MTXP02IBCCZ.17.57.F02.1.454.CMB.2.raw
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctcttgccgggcaagtcagagcattagctaacttttaaatggtatcagcggaacaggaacgcccctaaactcctgatctatactgcatccaatttgacaaagtgggtccatcaagtcagtgcagtgatctggggacagtatttcactctacaccatcagcagtctgcaactgagtatttgactaactttactacttagtactaaacgtacgggttaccacgttaacccccgttataccgtttttacgggacccgttaacgggggaacccaaaggtccttagggggaaacgtaacttaacccgaaaaccggtaaaccgttggttcgggaacttcggacccaacccgtaaatttcccgtttacg

SEQ ID NO: 331232 - DNA, 509 bp, Homo sapiens
  misc_feature: GZ8MTXP02FOKVK.17.57.F02.1.454.CMB.2.raw
  modified_base (216)..(216): a, c, t, g, unknown or other
  misc_feature (216)..(216): n is a, c, g, or t
  modified_base (290)..(290): a, c, t, g, unknown or other
  misc_feature (290)..(290): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctntgccgggcaagtcagagcattagactaacttttaaattggtatcagacgggaaccagggaaacgcccctaaacncctgatctatactgcatccaatttgacaaagtgggtaccatcaagtcagtgcagtgatcgtgggacagtatttcactctcaccatcagcagtctgacactgagtatttgactaacttactactagtacaacgtaggttacacgtaccctatacgtttcggacgtagggaccaagcgtaggagactacaaacgaacgtgtacggctcgacaccatctacg

SEQ ID NO: 331233 - DNA, 505 bp, Homo sapiens
  misc_feature: GZ8MTXP02ILB9K.17.57.F02.1.454.CMB.2.raw
  modified_base (221)..(221): a, c, t, g, unknown or other
  misc_feature (221)..(221): n is a, c, g, or t
  modified_base (391)..(391): a, c, t, g, unknown or other
  misc_feature (391)..(391): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctcctgtctgcatctgtagagacagagtcacatctcttgccggnaagtcagagcattagctaacttttaaatggtatcagcggaacaggaaacgcccctaaatctgatctatactgcatccaatttgacaaagtggtccatcaagttcagtgcagtggatctgggacagtatttcactctcaccatcagtcagtctgcaaacctgagtattttnacaactttactactgtacaaacgagggttacagtaccccgtatacgtttggccaacggggaccaaagcgtaggaagtactacgaaaacgaactgtggctagactaccaatctcg

SEQ ID NO: 331234 - DNA, 504 bp, Homo sapiens
  misc_feature: GZ8MTXP02ITG6R.17.57.F02.1.454.CMB.2.raw
  modified_base (270)..(270): a, c, t, g, unknown or other
  misc_feature (270)..(270): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggcaagtcagagcattagctaacttttaatgtatcagcggaaccaggaaacncccctaaactcctagatctatactgcatccaatttgacaaagtcgggtccatcaagttcagtgcagtgatcgtggacagtattcactctacacatcagcagtctgcaactgagtatttgactacttactactgtacaacgtaggttacacgttacccgtactacgtttcgaccgtagggacctaacgcgtacggaacatacgaaacgacgtgtagcgtgacacatctagtctac

SEQ ID NO: 331235 - DNA, 519 bp, Homo sapiens
  misc_feature: GZ8MTXP02HCF60.17.57.F02.1.454.CMB.2.raw
  modified_base (278)..(278): a, c, t, g, unknown or other
  misc_feature (278)..(278): n is a, c, g, or t
  modified_base (404)..(404): a, c, t, g, unknown or other
  misc_feature (404)..(404): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaatggtatcagcggaaccaggaaacncccctaaactcctagatctaatactgcatacctaaatttgactaaaaggtcggggtacccaatacaaaggttcaagttggcaggtggatcgtagggacagtatttcactctcaccatcagcagtcngcaactgagtatttgactaacttacactgtacaacgaggttacacgtacccgtatacgtttgaccagggacctaagctggaacactacgaaaacgactgtgactgacacatctcg

SEQ ID NO: 331236 - DNA, 484 bp, Homo sapiens
  misc_feature: GZ8MTXP02FULPY.17.57.F02.1.454.CMB.2.raw
  modified_base (271)..(271): a, c, t, g, unknown or other
  misc_feature (271)..(271): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatgtatcagcggaaccaggaaancccctaaatcctgatctatactgcatccaatttgacaaagtgggtccatcaaggttcagtgcagtgatcgtgggacagatttcactctcacatcagcagtctgcaactgagtatttgacaacttactactgtcaacaggttacagtaccccgtatactttggaccaggggaccaagctaggagatacaaacgactgtgctgcacatctctctc

SEQ ID NO: 331237 - DNA, 524 bp, Homo sapiens
  misc_feature: GZ8MTXP02FT0W6.17.57.F02.1.454.CMB.2.raw
  modified_base (495)..(495): a, c, t, g, unknown or other
  misc_feature (495)..(495): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaatggtatcagcggaaccagggaaacgcccctaaatcctgatctatactgcatccaatttgactaaagtcggggtacccatcaaggttcagtgcagtgatcgtgggacagatttcactctcaccatcagcagtctagcaacctgagtatttgtaaacttactatgtacaacgtagggttacaacgtacccgtatacgttttggcctaaggggaccaagtcgtaggagtactacgaaaacgaacgttgnggactgacaaccatctcgtcttactaccg

SEQ ID NO: 331238 - DNA, 564 bp, Homo sapiens
  misc_feature: GZ8MTXP02IGBTK.17.57.F02.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
  modified_base (443)..(443): a, c, t, g, unknown or other
  misc_feature (443)..(443): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagatcaccatctcttgccgggnaagtcagagcattagactaaactttttaaatggtatcgaggcggaaccagggaaacncccctaaatcctgatctaatactgactatacctaatttgacgtaaaaggtcggggtacccaagtaccgaaaggtttcaaggtggacagtgggatcgaggggacagtatttcactctacacatcagcagtctgacaacgtgagtattttcgactaaactttanactgtaccaagtacgggttacacgttacccgtatacgtttgacccgtaggggaacctaaggctagggaacttacaaaccgtaaacgtacgtggtcgacttacgactaaccgtattcgttac

SEQ ID NO: 331239 - DNA, 558 bp, Homo sapiens
  misc_feature: GZ8MTXP02JST1Z.17.57.F02.1.454.CMB.2.raw
  modified_base (279)..(279): a, c, t, g, unknown or other
  misc_feature (279)..(279): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccgggcaagtcagagcattagctaactttttaaatggtatcagcgggaaccagggaaacncccctaaactcctgatctatactgcatccaatttgactaaaggtcggggtacccatcaaggttcagtggcagtggatcgtgggacagtatttcactctcaccatcagcagtctgcaacctgagtattttgactaactttacattcgtacaaacgtagggtttaaccacggttaacccccgtatacgttttcggacccgtaacgggggacccaaaggcgtagggaaactacgtaaccgaaaacgtacgtggtacggactcgacctacctacgtcgttacg

SEQ ID NO: 331240 - DNA, 685 bp, Homo sapiens
  misc_feature: GZ8MTXP02J4KKV.17.57.F02.1.454.CMB.2.raw
  modified_base (242)..(242): a, c, t, g, unknown or other
  misc_feature (242)..(242): n is a, c, g, or t
tcagcgtagactagcacgaccggtgctcgatttagctcgatataggttggggtttggggggagtcagtctcagtcaggacacagcatggacatggacgggtccccgctcagctccgtggggctcctgctactctggctccggaggtgccagatgtgacatccagatcgacccagtcctccatccctcctgtctgcatctaggtaaggagacagactccaacctatcctcgttcggccggganaaggtcagagtactaattagtacttaacttttaaagttaggtagtacgacggaccgggaaccggaacgggaaaccgtaacccctaacctacctacgtactactactactactacgggggggggtaactacctaacgttacgtaacgtaaacgggtaccggggtacccgtacgtacgtaaccggttacgtaggtacggtacgtaggtaggtacgtcggtacgggtaacgtacgtactttacctacctacctaccaacctactacacgtacgtacgtcgtacgacctaaccgtagtaaggttactttacgtacttaacttactacgtacgtacgtaacggtacggttaaccgtaccgttacccgtaccgttacggttacggacggacggacgacgacgagacgacaacgaacgacgtagtcgtcgtacgaccactactctctctc

SEQ ID NO: 331241 - DNA, 577 bp, Homo sapiens
  misc_feature: GZ8MTXP02GRK6C.17.57.F02.1.454.CMB.2.raw
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggcaagtcagagcattagctaacttttaaatggtatcgagacggaacagggaacacccctaaatcctgatctatactgcatcctaatttcgactaaaggtcggggtaccagtacgaacggttcaggtggactaggtaggatcggtagggaactaggtactttccacttactccaaccatcagtctagtcctagaccaacgtggaacggttatttcgactaaactttactacttacgtacaacgtagggttaaccacgttaccccgtatacgtttcggccgaaggggaccaagcgtaggaactaacgtacgaaaacgtacttggacggaactcgaacctacctatctcgtactttac

SEQ ID NO: 331242 - DNA, 534 bp, Homo sapiens
  misc_feature: GZ8MTXP02H5S3E.17.57.F02.1.454.CMB.2.raw
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccggcaagtcagagcattagactaacttttaaatggtatcagcggaacaggaacncccctaaactctgatctatactgctatccaatttgacaaaggtcggggtaccatacgaaggttcagtgcagtggatgtgggacagtattcactctcaccatcagcagtctcgaccaacgtgagtatttagacttaaactttactactgtacaagtacggttactacgtacccgttacgtacgtttcggaccgtacggggaccaagacgtaggaactacgtaacgaaacgacgtgacgcgtcgacacctagtcttcgtacttcc

SEQ ID NO: 331243 - DNA, 592 bp, Homo sapiens
  misc_feature: GZ8MTXP02GICQ7.17.57.F02.1.454.CMB.2.raw
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (364)..(364): a, c, t, g, unknown or other
  misc_feature (364)..(364): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaatggtatcagcggaacaggaaancccctaaancctgatctatactgcatccaatttgacaaagtgggtccatcaagttcagtggacagtggatcgtgggacagtattcactctnaccatcagcagtctagcaactgagtatttgactaactttacacttgacaaacgacgggtttaaccacggttaacccccgttactaacgtttttcgggacccgtaagggggtaaccccaaaggggtaccttaggggaagttaaactaaaccgtaaaaaccggaaaccttgggttacgggaacctttacggaaccttaacccgaagtttcttacggtttacctttacccg

SEQ ID NO: 331244 - DNA, 553 bp, Homo sapiens
  misc_feature: GZ8MTXP02JDEK7.17.57.F02.1.454.CMB.2.raw
  modified_base (278)..(278): a, c, t, g, unknown or other
  misc_feature (278)..(278): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaactttttaaatggtatcaggacggaaccagggaaacncccctaaactcctgattctatactgcatcctaaatttgacaaaggtcgggtcccatcaaggttcagtgcaggtggatcgtgggacagtattcactctcaccatcagcagtcctgaccaacgtgaacgtatttgactaacttactactgtacaacgtaggttacacgtacccgtatacgtttggaccgtagggaccaagccgtagggaactaactaaccgaaaacgaccgtttggacggaacttcggaccacctattccgttacgttctttaaccg

SEQ ID NO: 331245 - DNA, 505 bp, Homo sapiens
  misc_feature: GZ8MTXP02JLDKD.17.57.F02.1.454.CMB.2.raw
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcgggaaccagggaaacgcccctaaactcctgatctatactgcatccaatttgacaaagtggggtcccatcaaggtcagtgcagtggatctgggacagtatttcactctcaccatcagcagtctgcaactgagatttgactacttactactgacaacaggttacacgtacccgtactacgtttggaccaggggaccaaggctaggacgatacaaaacgtactgtaggctgacacctatcctgtcttcc

SEQ ID NO: 331246 - DNA, 523 bp, Homo sapiens
  misc_feature: GZ8MTXP02JKL2I.17.57.F02.1.454.CMB.2.raw
  modified_base (222)..(222): a, c, t, g, unknown or other
  misc_feature (222)..(222): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaacttttaaatggtatcagcgggaaccagggaaacgcccctaaactcctgatctatactgcatccaaatttgacaaagtggggtcccatcaaggttcagtggcagtggatcgtgggacagtattcactctcaccatcagcagtctgacaacctgaaacgtattttgactaaactttactactgtacaactagacttaacaacttacccctggctacgtacgtttcggacggaggaccaaggtcggaagactacaaacgactgtcggactgacacctatcgtacg

SEQ ID NO: 331247 - DNA, 531 bp, Homo sapiens
  misc_feature: GZ8MTXP02HNWEZ.17.57.F02.1.454.CMB.2.raw
  modified_base (275)..(275): a, c, t, g, unknown or other
  misc_feature (275)..(275): n is a, c, g, or t
  modified_base (504)..(504): a, c, t, g, unknown or other
  misc_feature (504)..(504): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatctcttggccgggcaagtcagagcattagctaacttttaatggtatcagcggaacagggaaacncccctaaactcctgatctatactgcatcctaatttgactaaaggtggggtcccatacaaggttcagtgcagtggatcgtagggacagtatttcactctacacatcagcagtctagacctaacgtggtagtatttcgactaacttactactgtacaacgtaggtacacgtaccctactacgttcggaccgaggggaccaaggcgtaggacgtactacgaaacgtacgtgnggtctcgactaccatcctcgttcttac

SEQ ID NO: 331248 - DNA, 545 bp, Homo sapiens
  misc_feature: GZ8MTXP02IP9RL.17.57.F02.1.454.CMB.2.raw
  modified_base (273)..(273): a, c, t, g, unknown or other
  misc_feature (273)..(273): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccaggaaacncccctaaactcctgatctatactgcatcctaatttgactaaaggtcggggtaccccagtcaaggttcagtggcagtggatcgtgggacagtatttcactctcacatcagcagtctgcctaacgtgagtatttgactaacttactactgtaccaagtacggtacacgttacccgtatacgtttggacctaggggacctaaggcgtagggaacgtataccgaaaacgtaaccgttgtacggtcgtacgacctaccgacttcttcgttactttcc

SEQ ID NO: 331249 - DNA, 503 bp, Homo sapiens
  misc_feature: GZ8MTXP02FUR9T.17.57.F02.1.454.CMB.2.raw
  modified_base (279)..(279): a, c, t, g, unknown or other
  misc_feature (279)..(279): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
  modified_base (482)..(482): a, c, t, g, unknown or other
  misc_feature (482)..(482): n is a, c, g, or t
tcagcgtagactagcacgaccggtgctcgatttagctcgatatagttgggcttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaactttttaaatggtatcagacgggaaccagggaaacncccctaaatcctgatctatactgcatccaatttgcaaagtgggtcccatccaagttcagtggcagtggatctgggacagtatttcactctcacatcagcagtcngacacgtgagtntttgactaacttactatagtacaaagtacggttacaccgtaccctatcgtttggacgtacgggacagctaggatactacgaaaacgntgtgctcgaccactctctctc

SEQ ID NO: 331250 - DNA, 522 bp, Homo sapiens
  misc_feature: GZ8MTXP02JZ6Y2.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcgggaaccagggaaacgcccctaaactcctgatctatactgcatccaatttgcaaagtgggtccatcaagttcagtggcagtgatctgggacagtatttcactctcaccatcagcagtctgcaactgagtattttgactaacttactactgtacaaacgagggttacacgttaccccgtataccgttttcggacctacggggacccaaaggctaggagactaccgaaaacgtactgtacggactcgacacctactctacg

SEQ ID NO: 331251 - DNA, 585 bp, Homo sapiens
  misc_feature: GZ8MTXP02I9QWW.17.57.F02.1.454.CMB.2.raw
  modified_base (278)..(278): a, c, t, g, unknown or other
  misc_feature (278)..(278): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagactaacttttaaatggtatcagcggaacagggaaacncccctaaatcctgatctatactgctatacctaatttcgactaaaggtcggggtaccccaagtaccgtaaagggttcaaggttggacctaaggttcggggaacttccggtaggggaacctagtactttacacttcctacaaccctatacgagctagtctgactaactagagtatttgactaacttactactgtaacaacgtacggttaactacgtaaccccgtataccgtttcggaccgtaacggggaccaaggcgtaggacgtactaacgaaacgtacgtggtacgctacgacctacctagttctcg

SEQ ID NO: 331252 - DNA, 511 bp, Homo sapiens
  misc_feature: GZ8MTXP02G3VYL.17.57.F02.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaacttttaaatggtatcagcggaaccagggaaacncccctaaagtcctgatctatactgcatccaatttgacaaaggtgggtccatcaaggttcagtgcagtggatcgtgggacagatttcactctcacatcagcagtctgcaacctgagtatttgactaacttacactgtacaacgtaggttacacgtacccgtactactttcggactaggggacctaagcgtaggagactacaaacgtactgtcggctcgaccactatcctgtctttacc

SEQ ID NO: 331253 - DNA, 564 bp, Homo sapiens
  misc_feature: GZ8MTXP02HDQBJ.17.57.F02.1.454.CMB.2.raw
  modified_base (281)..(281): a, c, t, g, unknown or other
  misc_feature (281)..(281): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaatggtatcaggacggaaccagggaaacncccctaaatcctgatctatactgcatcctaatttgactaaagtcggggtaccatacaaggttcaggtggcagtggatcgtgggacagtatttcactctcaccatcagcagtctagacctaaaccgtgaaggttattttacggacctaactttactactagtacaaacgtacgggttacacgttacccgtattacgtttcgggacccgtaacgggggaccaaggtcgtagggaactactaccgaaaacgtaacgtggtacggctacgacctactactcgttacg

SEQ ID NO: 331254 - DNA, 497 bp, Homo sapiens
  misc_feature: GZ8MTXP02JZCGY.17.57.F02.1.454.CMB.2.raw
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
  modified_base (357)..(357): a, c, t, g, unknown or other
  misc_feature (357)..(357): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgaccccagtctccatcctccctgtctgcatctgtaggagacagagtcaccatctcttgcggcaagtcagagcnttagcaactttttaaatggtatcagcgggaaccaggggaaancccctaaatcctgatctatactgcatccaatttgcaagtggggtccatcaagttcagtggcagtggatctggggacagntttcactctcaccatcagcagtctgacactgaggtattttgacaacttactactgtcaacagggttacagtaccccgtactacgttttgaccgaggggaccaagctggagactacaaacgaactgtggctgcaccatctg

SEQ ID NO: 331255 - DNA, 560 bp, Homo sapiens
  misc_feature: GZ8MTXP02GMDLV.17.57.F02.1.454.CMB.2.raw
  modified_base (518)..(518): a, c, t, g, unknown or other
  misc_feature (518)..(518): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccagggaaacgcccctaaatcctgatctatactgctataccaatttgactaaaaggtcggggtaccccaagtacgaaacggtttcaaggttgggacctaggtggaatccgtggggaactaggtaatttccaacttctacaccatcaagcaagtctacgacaaccgtgagttatttgacctaacttactactgtacaaacgtagggttaaccacgttacccgtactactttcggacgtagggaccaagcgtagganaatacaaaacgtacgtgtggctgactaccatctcgtcttacg

SEQ ID NO: 331256 - DNA, 555 bp, Homo sapiens
  misc_feature: GZ8MTXP02FTV8F.17.57.F02.1.454.CMB.2.raw
  modified_base (282)..(282): a, c, t, g, unknown or other
  misc_feature (282)..(282): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccgggcaagtcagagctattagactaaacttttaaatggtatcaggacggaaccagggaaacncccctaaactcctagatctatactgctatacctaatttgacaaaggtcggggtcccagtcgaaggttcaggtggactaggtggatcgtagggacagtatttcactctcaccatacagctagtctagactaacgtgacgttatttagactaacttactactagtaccaacgtaggttaccacgttacccgtattacgttacggacgacgggtaccagtcgtaggagtactaacgaaacgtcgtaaggtacggcgtacacctacctagttcttcg

SEQ ID NO: 331257 - DNA, 512 bp, Homo sapiens
  misc_feature: GZ8MTXP02HJPXB.17.57.F02.1.454.CMB.2.raw
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
  modified_base (410)..(410): a, c, t, g, unknown or other
  misc_feature (410)..(410): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcgggaaccagggaaacncccctaaactcctgatctatactgcatccaatttgacaaagtgggtccatcaaggttcagtgcagtgatntgggacagatttcactctcaccatcagcagtctgacaacttgagtattttgacaactttanactgtacaacctagggttaccaacgttaccccgtatacgtttggaccgtaggggacctagcgtaggactatacaaacgactggtagcctgacctacatcctg

SEQ ID NO: 331258 - DNA, 573 bp, Homo sapiens
  misc_feature: GZ8MTXP02FNULI.17.57.F02.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (383)..(383): a, c, t, g, unknown or other
  misc_feature (383)..(383): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggnaagtcagagcattagctaacttttaaatggtatcagcgggaaccagggaaacgcccctaaatcctgatctatactgcatccaatttgacaaagtggggtccatcaaggttcagtggcagtggatctgggacagtatttcactctcaccatccagcagtctncaacctagaggtatttagtacaaacttaacttactagttacaaacgtaacggttaaccgtaacgtaacccgttaacctaacgttttacggtaccgaacggggaaccgaaacgacgttaggaacggaagttaacaaaacgaaaccgtaaggttagggtaaccgtacgaccacctactactacgttacttac

SEQ ID NO: 331259 - DNA, 532 bp, Homo sapiens
  misc_feature: GZ8MTXP02FEASQ.17.57.F02.1.454.CMB.2.raw
  modified_base (220)..(220): a, c, t, g, unknown or other
  misc_feature (220)..(220): n is a, c, g, or t
  modified_base (368)..(368): a, c, t, g, unknown or other
  misc_feature (368)..(368): n is a, c, g, or t
tcagcgtagactagcacgaccggtgctcgatttagctcgatatagttgggtttggggtagtcagtctcagtcaggacacagcatggacatgagggtccccgctcagctcctggggctcctgctactctggctccgaggtgccaaatgtgacatccagatgacccagtctccatcctcctgtctgcatctgtaggagacagagtcaccatctcttgccggnaagtcagagcattagctaactttaaatggtatcagcgggaaccaggaaagccccctaaatcctgatctatactgcatccaaatttgcaaaggtgggtccatcaaggttccagtggcagtggatctgggacagtatttcatctcaccancagcagtctcgactaacgtgtagttatttacactaaacttactactgtacgaacgtacgggtacaccgtacccgtacgtacgttcggacgacgggacaagtcgaggagtaactaaacgaaacgtacgtggtcgactcgactacctactacttcttacttactac

SEQ ID NO: 331260 - DNA, 534 bp, Homo sapiens
  misc_feature: GZ8MTXP02IRUBK.17.57.F02.1.454.CMB.2.raw
  modified_base (274)..(274): a, c, t, g, unknown or other
  misc_feature (274)..(274): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccagggaaacncccctaaactcctgatctatactgcatcctaatttcgacaaaggtcggggtacccaagtcctaaggttcagtggcagtggatcgtgggacagtatttcactctacaccatcagcagtctgcaactgagtatttcgactaactttactacttgtacaacgtacggtactacgtaccccgtatacgtttggaccgtagggaccaagcgtaggaacaactacgaaacgtacgtgacgaacgtcgacctactatctcgttactc

SEQ ID NO: 331261 - DNA, 537 bp, Homo sapiens
  misc_feature: GZ8MTXP02JU1RR.17.57.F02.1.454.CMB.2.raw
  modified_base (280)..(280): a, c, t, g, unknown or other
  misc_feature (280)..(280): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctcttgccgggcaagtcagagcattagctaaacttttaaatggtatcgagcgggaaacagggaaacncccctaaactcctgactctatactgcatcctaatttgactaaggtcgggtccatcaagttcagtggcaggtgatcgtagggacagtactttcactctacaccatcacgctagtctagaccaacctgtaggttatttgacctaactttactactgtacaacgtacgggttacacgttacccctagtacgtttcggaccgtacggggaccaagcgtagacgactacgaaacgtactggtacgctcgaccactatcttcg

SEQ ID NO: 331262 - DNA, 506 bp, Homo sapiens
  misc_feature: GZ8MTXP02JYFKZ.17.57.F02.1.454.CMB.2.raw
  modified_base (497)..(497): a, c, t, g, unknown or other
  misc_feature (497)..(497): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccagggaaacgcccctaaactcctgatctatactgcatccaatttgacaaagtggggtcccatcaaggttcagtggcagtgatctgggacagtattcactctcaccatcagcagtctgcaacctgagattttgactaaacttacgactgtaccaaagtagggttaaccagtaccccgtatactttggccaggggaccagctggacgatacaaacgacttgaggctagcaacctntctcgtctc

SEQ ID NO: 331263 - DNA, 510 bp, Homo sapiens
  misc_feature: GZ8MTXP02G6KAX.17.57.F02.1.454.CMB.2.raw
  modified_base (447)..(447): a, c, t, g, unknown or other
  misc_feature (447)..(447): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaatggtatcagcggaaccagggaaacgcccctaaatcctgatctatactgcatccaatttgacaaagtgggtaccatcaaggttcagtggacagtggatctgggacagtatttcactctcacatcagcagtctgacaactgaggtattttgactaaactttacgactgtacaaacgtaggtaacagtaccccgtanactttggactaggggaccaagctaggagactacaaacgaactgaggactgacacctatctacg

SEQ ID NO: 331264 - DNA, 544 bp, Homo sapiens
  misc_feature: GZ8MTXP02HBL7P.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttggccggcaagtcagagcattagctaaacttttaaatggtatcaggacggaacaggaaacgcccctaaactcctagatctatactgacactacctaatttgaactaaaggtcggggtaccagtacgaagttcaggtggacaggtggatcgtagggacagtactttcactctcaccatcagcagtctgacctaacgtgagttatttcgaactaacttactacgtagtacaacgtacggtactacgtaccctactacgtttcgaccgtaacggaccgaagcgtaggaacgactaacgaaacgacgtgtcgactcgacacctatctcg

SEQ ID NO: 331265 - DNA, 582 bp, Homo sapiens
  misc_feature: GZ8MTXP02HU7OC.17.57.F02.1.454.CMB.2.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaactttttaaatggtatcagcggaaccagggaaacncccctaaatcctgatctatactgcatccaatttgacaaagtgggtacccatcaaggttcagtgcagtggatcgtgggacagtatttcacttctcacatcagcagtctagcaacctgaggtattttgactaactttactacttgtacaaacgtagggttaccacgtaccccgttactacgttttcggaccgtaaggggaaccctaaggtaccgttaggggaaactacgttaaccgaaaaacgtaaccgttggtacgggaaccttacggaccgtaaacccgtaattacctttcggtttaccctttaccg

SEQ ID NO: 331266 - DNA, 570 bp, Homo sapiens
  misc_feature: GZ8MTXP02F6ERN.17.57.F02.1.454.CMB.2.raw
  modified_base (275)..(275): a, c, t, g, unknown or other
  misc_feature (275)..(275): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcaggcggaaccagggaaacncccctaaatcctgatctatactgcatccaatttgactaaagtcggggtccatcaaggttcagtgcagtgatcgtgggacagtattcactctcaccatcagcagtctgcaactgagtatttgactaacttactactgtacaacgtagggttaccacgtaccccgtatacgtttcggaccgtaggggaacccaaggtccgttagggaaacgtaacgttaacgaaaaaccggtaaaccttgggttacggaacctttacgggacctacccgtaattcccgttacgtttacctttacccg

SEQ ID NO: 331267 - DNA, 535 bp, Homo sapiens
  misc_feature: GZ8MTXP02JJK42.17.57.F02.1.454.CMB.2.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
  modified_base (365)..(365): a, c, t, g, unknown or other
  misc_feature (365)..(365): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagactaactttttaaatggtatcagcgggaaccaggggaaacncccctaaactcctgactctatactgacatcctaatttgacaaaggtcggggtacccagtcgaaggttcagtgcagtggatcgngggacagtatttcactctcacatcagcagtctgcaactgagtatttgactaacttactatgtacaacgtaggttactacgtacccgtatacgtttggaccgtaacggggactaaggcgtaggacgtacgtaacaaacgtacgtggtacggctacgaccacgtactcgtcg

SEQ ID NO: 331268 - DNA, 647 bp, Homo sapiens
  misc_feature: GZ8MTXP02F87BV.17.57.F02.1.454.CMB.2.raw
  modified_base (228)..(228): a, c, t, g, unknown or other
  misc_feature (228)..(228): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtctccatccctccctgtctgcatctggtaggagacagagtcaccatctctgccgggnaagtcagagcattagacttaaacttttaattggtatcaggaccgggaaacaagggaaacgacccctaaactctagactactaatactgactaactacctaatttcgacgtaaaggttccggggtacccagtaccgtaaggttacgaggtggacaggtggatcgtagggacagtattcactctcacatcagctagtctacgactaactaggacgttatttacgacttaaaccgtttactacgttacggtacctaaaacggttacgggttaacctaaaccggtttaacccccgttaacgttaaccgttttaccgggacccggtaaaacgggggtaccctaaagggtccgttaagggaaacgtacgtaaaaccgtaaaccgtaagtcggtacggtactaccggacctaactcgttctttacg

SEQ ID NO: 331269 - DNA, 499 bp, Homo sapiens
  misc_feature: GZ8MTXP02G0XRS.17.57.F02.1.454.CMB.2.raw
  modified_base (283)..(283): a, c, t, g, unknown or other
  misc_feature (283)..(283): n is a, c, g, or t
  modified_base (411)..(411): a, c, t, g, unknown or other
  misc_feature (411)..(411): n is a, c, g, or t
  modified_base (464)..(464): a, c, t, g, unknown or other
  misc_feature (464)..(464): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaacttttaaatggtaatcagcggaaccagggaaagcccctaaaancctgatctatactgcatccaatttgcaaaagtggggtcccatcaaaggtcagtgcagtggatctgggacgagattctactctcaccatcagcagtctgcaacctagaggatttgtcaacttactactntcaacagtacacgtacccgtactacttgtacgacggacgaacgacgtgagaanacaaacgaacgtagtgcgtcgacacactctctctc

SEQ ID NO: 331270 - DNA, 597 bp, Homo sapiens
  misc_feature: GZ8MTXP02ID169.17.57.F02.1.454.CMB.2.raw
  modified_base (201)..(201): a, c, t, g, unknown or other
  misc_feature (201)..(201): n is a, c, g, or t
tcagcgtagactagcacgaccggtgctcgatttagctcgatatagttgggtttgggggagtcagtctcagtcaggacacagcatggacatgacgggtccccgctcagctcctggggctcctgctactctggctccgaggtgccagatgtgacatccagatcgacccagtcctccatccctccctgtctgcatctgtagganacagagtcacatctcttgccgggcaagtcagagcattagctaattttaatggtatcagcggaacaggaaacgacccctaaactcctagatctatactgcatcctaatttgacaaaggtcggggtacccatacgaacggttcagtgctaggtgatgtagggacagtatttcactctacaccctatcagcagtctgacaactgaggtattcgactaacttactacttcgtactaaacgtacggttaaccaacggttaaccccctagttaccgttttacgggaccgtaaacgggggtaaccccaaggtacgtaggggaaataaacttaaccgtaaaacggaaccgttggtaccgggaacgttcgacctactaactttcccgttaagtttcctttaaccc

SEQ ID NO: 331271 - DNA, 589 bp, Homo sapiens
  misc_feature: GZ8MTXP02IOFF0.17.57.F02.1.454.CMB.2.raw
  modified_base (199)..(199): a, c, t, g, unknown or other
  misc_feature (199)..(199): n is a, c, g, or t
  modified_base (280)..(280): a, c, t, g, unknown or other
  misc_feature (280)..(280): n is a, c, g, or t
tcagcgtagactagcacgaccggtgctcgatttagctcgatatagttgggttttgggggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatctcttgccgggcaagtcagagcattagcttaaacttttaaatggtatcgagacgggaaccagggaacncccctaaactcctgatctatactgcatcctaatttgactaaaggtcgggtacccagtacgaaggtttcagtcggactaggtggactcggtagggactagtactttaccacttcctaccaacctataccgagcaggttcctacggaccctaacgtggtaacgtatttcgacttaacgtttactactgtacaacgtacgggttaccacgttacccgtattacgttcggaccgaggggtaccaaggtcgtaggaacgtaactacgaaaacgtacgtggacggtctcgactaccgtatccgttacttcttacc

SEQ ID NO: 331272 - DNA, 545 bp, Homo sapiens
  misc_feature: GZ8MTXP02JIGOH.17.57.F02.1.454.CMB.2.raw
  modified_base (274)..(274): a, c, t, g, unknown or other
  misc_feature (274)..(274): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccagggaaacncccctaaactcctgatctatactgcatccaaatttgactaaaggtcggggtacccatcaaggttcagtgcagtggatctgggacagatttcactctcaccatcagcagtctgcaactgagtatttgactaaacttactactgtacaacgtagggttacacggttaccccgtactacgttttcgggaccgtagggggaacccaaggtccgtagggaacgtattaaccgaaaacgaaccgtggtacggctaggacacctatcttcgtctttac

SEQ ID NO: 331273 - DNA, 524 bp, Homo sapiens
  misc_feature: GZ8MTXP02I9NXU.17.57.F02.1.454.CMB.2.raw
  modified_base (196)..(196): a, c, t, g, unknown or other
  misc_feature (196)..(196): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatctcttgccggcaagtcagagcattagctaacttttaaatggtatcagcggaaccaggaaacgcccctaaactcctgatctatactgcatcctaatttcgacaaagtcggggtacccatcaaggttcagtgacagtggatcgtgggacagtatttcactctcacatcagcagtctgcaactgagtatttcgactaacttactacttgtacaacgtaggttacacggttaccctactacgtttcggaccgaggggacaacgtcgtaggacgactacgaaaacgactgtacgaacgtgaccacgtatctcgtctttac

SEQ ID NO: 331274 - DNA, 582 bp, Homo sapiens
  misc_feature: GZ8MTXP02F9QWT.17.57.F02.1.454.CMB.2.raw
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgttcccatcgactacgccttcggcctcgccttaggggtcactcaccctgccccgattaacgtgacaggaacccttggtcttccggcgagcgggtctttcaccgtctttatcgttactatgtcagcattcgcacttctgactacctcagcatcgcctcacagcacnccttcacngactacagaaccncctaccccctaaccaacaacgcanaacgcgtcgctcgacccncacgtcttcggnacctagttcgggtttacctccccgtttcacttcccgttccccgctacgtcctacgaccttacgttcc

SEQ ID NO: 331275 - DNA, 514 bp, Homo sapiens
  misc_feature: GZ8MTXP02G6JKZ.17.57.F02.1.454.CMB.2.raw
  modified_base (494)..(494): a, c, t, g, unknown or other
  misc_feature (494)..(494): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatctcttgccgggcaagtcagagcattagctaacttttaaatggtatcagcggaacagggaacgcccctaaactcctgatctatactgcatccaatttgacaaagtcggggtaccatccaaggttcagtgcagtgatcgtgggacagtattcactctcacatcagcagtctgcaacgtgagtatttacgactaaacttactactgtacaaacgtaggttacacgtacccgtatacgtttggaccgtaggggaccaaggcgtaggagactacgaaacgactgngactcgacacatctacgttc

SEQ ID NO: 331276 - DNA, 523 bp, Homo sapiens
  misc_feature: GZ8MTXP02HD0JD.17.57.F02.1.454.CMB.2.raw
  modified_base (274)..(274): a, c, t, g, unknown or other
  misc_feature (274)..(274): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatctctgccggcaagtcagagcattagctaacttttaaatggtatcagcggaacagggaaacncccctaaatcctgatctatactgcatcctaatttgactaaaggtcggggtacccatacctaaggttcagtggcagtggatcgtagggacagtatttcactactcaccatcagcagtcagactaactgacgtatttgactacttacactgtacaacgtacggttacacgtacccgtatacgtttgaccgtacggggaccagcgtaggactacgtacaacgaactgtacggactcgaccacctagtcttcg

SEQ ID NO: 331277 - DNA, 504 bp, Homo sapiens
  misc_feature: GZ8MTXP02GS0UT.17.57.F02.1.454.CMB.2.raw
  modified_base (440)..(440): a, c, t, g, unknown or other
  misc_feature (440)..(440): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcgggaaccagggaaacgcccctaaactcctgatctatactgcatccaaatttgacaaagtggggtcccatcaagttcagtgcagtgatcgtgggacagatttcactctcacatcagcagtctgacaactgaggtattttgactaacttactacttgtacaacagggttacacgtacccgtanacgtttgacgaggggaccaagctaggacgaanacaacgacgtagngcgcgacacactctctctc

SEQ ID NO: 331278 - DNA, 678 bp, Homo sapiens
  misc_feature: GZ8MTXP02J05WD.17.57.F02.1.454.CMB.2.raw
  modified_base (202)..(202): a, c, t, g, unknown or other
  misc_feature (202)..(202): n is a, c, g, or t
tcagcgtagactagcacgaccggtgctcgatttagctcgatatagttggggtttggggggagtcagtctcagtcaggacacagcatggacatgagggtccccgctcagctcctggggctcctgctactctggctccgaggtgccagatgtgacatccagatcgacccagtcctccatccctcctgtctgcatctggtagganacagagtccaccatctcgttcggccgggacaaggtcagagctattagacttaaactttttaaatggtatcgaggaccggaaaccgaagggaaaccgacccctaaactcctagatactatactgactatacctaagtttgacgtaaaggtcgggtacccaagtacgtaacggttcgaaggttcggacgtaggtggtacgttcggtacggggtaactagttactttaccaccttacctaccaacctacgtacacggtactaacggtctacgacctaaccgttagtaaccggttatttacgaccttaaaccttactacgtacgtaaccgtaaacgggttaacgggttaacctaaccggttaaccccgttaacgttaccggtttccggaaccggaacggggtaaccaaaggtcgaggaacgaactaacgaaaacgacgtggtacggaactacgaccaaccttacttcgtacgttactacg

SEQ ID NO: 331279 - DNA, 537 bp, Homo sapiens
  misc_feature: GZ8MTXP02H1DUY.17.57.F02.1.454.CMB.2.raw
  modified_base (201)..(201): a, c, t, g, unknown or other
  misc_feature (201)..(201): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatctcttgccgggcaagtcagagcattagactaaactttttaaatggtatcaggcgggaaccaggggaacacccctaaactcctagatctatactgctatacctaatttgactaaaggtcggggtaccatacgaaaggttcaaggtggcaggtgatcgtgggacagtactttcactctacacatcagctagtcngacaactgagtntttgaactaacttactactgtacaaagtacgggttacacgtacccgtactacgtttcggaccgtacggggaccaggactggaatacacgaaacgacttggacgctcgactaccattctcg

SEQ ID NO: 331280 - DNA, 516 bp, Homo sapiens
  misc_feature: GZ8MTXP02IB2MG.17.57.F02.1.454.CMB.2.raw
  modified_base (197)..(197): a, c, t, g, unknown or other
  misc_feature (197)..(197): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaacttttaaatggtatcagcggaaccagggaaagcccctaaactcctgatctatactgcatccaaatttgacaaaggtggggtcccatcaaggttcagtgcagtggatcgtgggacagtatttcactctacaccatcagcagtctgacaactgagtatttgactaactttactactgtacaacgtagggttacagttaccccgtatacgtttggaccaggggaccaaggctgggacatacaaaacgtactgtacggctcgactacatcttcgtcttc

SEQ ID NO: 331281 - DNA, 544 bp, Homo sapiens
  misc_feature: GZ8MTXP02FOP62.17.57.F02.1.454.CMB.2.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagcgtagactagcacgaccggtgctcgatttagctcgatatagttgggtttgggcgaggagtcagtctcagtcaggacacagcatggacatgagggtccccgctcagctcctggggctcctgctactctggctccgaggtgccagatgtgacatccagatgacccagtctccatcctccctgtctagcatctgtaggagacagagtcaccatcacttgccgggcaagtcagagcattagcagctattaatggatcagcagaaaccaggaagcccctaanctctgatctttnctgcatctacgtttagccaaagtcggggtcccttacgtaagtcgagtggcagtcgagtctgggacagtagtatactactctacactacacgcacgtacgtcgtcgtacctacgtaacgtattagttactacttacttactactactactacgtaacgtactaaaaaactccctaccgtaccgtacctacgtacggtacggtacggtaccggaacggtacggaagagacgtacgaacgtacgtacgacgtcg

SEQ ID NO: 331282 - DNA, 604 bp, Homo sapiens
  misc_feature: GZ8MTXP02FXU15.17.57.F02.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (421)..(421): a, c, t, g, unknown or other
  misc_feature (421)..(421): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatcctcctgtctgcatctgtagganacagatcacatctcgtcggccgganaagtcagagctattagacttaaacttttaagtggtatacgaggaccggaaccgaagggaaccacccctaaactcctagtactactatactgactactacctaagtttcgaacgtaaaggtcggtaccagtacgtagtcaggtgactaggtgtatcggtagggtacctagttacttaccactacctacaaccctanacgacgtcgtacgtctacgaccgtacgtagtagttacttactaacttaactactacgtacgtaacgtaacggtacgttaacctaccgttaccgtacgttacggtacggacggtaacggacacgtacgtacgaactacgtaacgtaacgtacgtcggtacgtacgtacgtactacgtactcgtc

SEQ ID NO: 331283 - DNA, 523 bp, Homo sapiens
  misc_feature: GZ8MTXP02FTC4U.17.57.F02.1.454.CMB.2.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaaacttttaaatggtatcgagcggaaccagggaaacncccctaaactcctgatctatactgcatccaatttgacaaagtcgggtccatcagttcagtgcagtgatcgtagggacagtatttcactctcaccatcagcagtctgctacgtgagtatttgactacttactactgtacaacgtagggttacacgttacccgtactacgtttcggaccgtaacggggaccaagtcgtaggacgactacgaaacgtacgtgtacggctacgacactactcttacg

SEQ ID NO: 331284 - DNA, 622 bp, Homo sapiens
  misc_feature: GZ8MTXP02IHT08.17.57.F02.1.454.CMB.2.raw
  modified_base (202)..(202): a, c, t, g, unknown or other
  misc_feature (202)..(202): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagatcaccatctcttggccgggcaagtcagagcattagcttaaactttttaaatggtatcaggcggaaaccagggaaacgcccctaaactcctagatctatactgcactacctaaatttcgactaaacgggtcggggtaccccaagttaccgtaagggtttcgaaggtgggtacctaaggggttgggtaacttacggtacgggggaaaccttaggtacttttaccaccttactaccaaccctaattccgaaagcctaagttcctagactaaaccgtggtaaggttattttacgactaaactttactactgtaaccaacgtaggttacacgtaccctattacttcggaccgtagggtaccaaggtctagggaactacgtaacgaacctaagtggtacggctacgacacctatcgttacg

SEQ ID NO: 331285 - DNA, 582 bp, Homo sapiens
  misc_feature: GZ8MTXP02IBSBM.17.57.F02.1.454.CMB.2.raw
  modified_base (202)..(202): a, c, t, g, unknown or other
  misc_feature (202)..(202): n is a, c, g, or t
tcagcgtagactagcacgaccggtgctcgatttagctcgatatagttgggtttgggggcaggagtcagtctcagtcaggacacagcatggacatgagggtcccccgctcagctcctggggctcctgctactctggctccgaggtgccagatgtgacatccagatgacccagtctccatccctcctgtctgcatctgtagganacagagtcaccatctcttggccggcaagtcagagcattagctaaacttttaaatggtatcaggcggaacaggaacgcccctaaactcctagactctatactgcatcctaaatttgactaaaggtcggggtacccagtacgtaaagggttcaggtggacgtaggtgggaacttcgtaggggactagtactttcactcctacactatcgagcagtctcgacaacctgagttacttttcgactaactttacattagtaccaaacgtacgggttaaccaccggttacccccgttataccgtttacggggacctaacgggggaacctaagcgtaggaacgactaaccgaaacgaactggtacgactacgacctacgtacttctcg

SEQ ID NO: 331286 - DNA, 553 bp, Homo sapiens
  misc_feature: GZ8MTXP02FXE7M.17.57.F02.1.454.CMB.2.raw
  modified_base (198)..(198): a, c, t, g, unknown or other
  misc_feature (198)..(198): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccggcaagtcagagcattagctaacttttaatgtatcagcggaacaggaaacgcccctaaactcctgatctatactgcatccaatttgactaaagtggggtacccaagtcaaacggttcagtggcagtggatcgtgggacagtatttcactctcaccatcagcagtctgactaactgagtatttcgactaaactttactacgttgtaccaaacgtagggttaccacgttaaccccgtacttacgtttcggaccgtaacgggggacccaaaggtcgtagggaaactactaacgaaaaccgtaactggtacggctcgacaccgtatctcgttcttacc

SEQ ID NO: 331287 - DNA, 531 bp, Homo sapiens
  misc_feature: GZ8MTXP02GK6MZ.17.57.F02.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctgccgggnaagtcagagcattagactaaacttttaatggtatcagacggaaccagggaaacncccctaaatcctagatctatactgcatccaatttgactaaaggtcgggtccatcgaagttcagtgcagtggatcgtaggacagtatttcactctcacatcagcagtctgaccaacgtagtaggtatttcgactaacttactactgtacaacgtaggttacacgtacccgtatacgtttgaccgtacgggaccagcgtaggactacgtaccgaaacgtacgtggtcggactacggacctaacgtcttcgttcg

SEQ ID NO: 331288 - DNA, 526 bp, Homo sapiens
  misc_feature: GZ8MTXP02G9794.17.57.F02.1.454.CMB.2.raw
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggcaagtcagagcattagctaacttttaaatggtatcaggacggaaccaagggaaacgcccctaaactcctgatctatactgcatccaatttgacaaaggtcggggtaccatcaaggttcagtggcagtggatcgtgggactagtatttcactctacaccatccagcagtctgcaactgagtatttgactaacttacactgtacaacgtaggttacacgtacccgtatacgtttcggaccgtaggggaaccaaggctaggacgtatacgaaacgacgtgtaggctggacctaccatctcgtactttc

SEQ ID NO: 331289 - DNA, 542 bp, Homo sapiens
  misc_feature: GZ8MTXP02JHQC8.17.57.F02.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (274)..(274): a, c, t, g, unknown or other
  misc_feature (274)..(274): n is a, c, g, or t
  modified_base (391)..(391): a, c, t, g, unknown or other
  misc_feature (391)..(391): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccggnaagtcagagcattagctaacttttaaatggtatcagcggaacaggaacncccctaaatcctgatctatactgctatccaatttgacaaaggtcggggtacccagtcgaaggttcagtggacagtggatcgtgggactagtactttcactctcaccatcagcagtcngcaacgtgagtatttgactaacttactatacgtacaacgtacggttacacggttaccccgtatacgtttcggaccgtaacggggaccaaggtccgtagggaacgactaacgaaaacgtaactggtcggaccttcggacacctactcgttcg

SEQ ID NO: 331290 - DNA, 523 bp, Homo sapiens
  misc_feature: GZ8MTXP02JH7UM.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaactttttaaatggtatcagcgggaaccagggaaacgcccctaaactcctgatctatactgcatccaatttgactaaaggtcggggtcccatcaaggttcagtggcagtggatctggggacagatttcactctcaccatcagcagtctgacaacctgacggtatttgactaacttactactgtacaactagggttacacgtaccccgtatacgtttaggactacggggaccaagctaggacgactacaaacgaactggtacggctcgacacctatctcg

SEQ ID NO: 331291 - DNA, 620 bp, Homo sapiens
  misc_feature: GZ8MTXP02HY8HV.17.57.F02.1.454.CMB.2.raw
  modified_base (273)..(273): a, c, t, g, unknown or other
  misc_feature (273)..(273): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggcaagtcagagcattagactaacttttaaatggtatcagcggaacagggaaacncccctaaatcctgatctatactgctatccaatttgactaaaggtcggggtacccatacgaaacggttcaggtggactaggttcgggattccggtggggaactaggtacttttaccgacttctccaacctatcagctagtctcgacctaacctgacgttatttacgacttaaactttactaacgtcgtacaacgtagggttacacgttaaccccgtagtacgttttcgggaccgtaacggggaaccaacggtcgttaagggaaacgtaacgttaaccgaaaaccggtaacgttacggtacgggtaacctacggtaccaaccttacgtccgtttacgtttcctttaccg

SEQ ID NO: 331292 - DNA, 535 bp, Homo sapiens
  misc_feature: GZ8MTXP02H7L9W.17.57.F02.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctcttgccgggnaagtcagagcattagctaatttaatggtatcagcggaacaggaaacacccctaaactcagatctatactgcatcctaatttgacaaagtcggggtaccatcgaaacggttcagtgctaggtggatcgtagggaacagttactttcactctaccacctatcagcagtctagacaactgagtatttgactaacttactactgactaacgacggttacacgttacccgtactacgtttgaccgtagggaccctaaggcgtaggaactacgtacgaaaacgtacgtgtaggcctagaccactgtctacgttctacg

SEQ ID NO: 331293 - DNA, 527 bp, Homo sapiens
  misc_feature: GZ8MTXP02F29MG.17.57.F02.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (276)..(276): a, c, t, g, unknown or other
  misc_feature (276)..(276): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccggnaagtcagagcattagactaacttttaaatggtatcagacggaacaggaacncccctaaatcctgatctatactgacatccaatttgactaaaggtcggggtaccagtacgaaggttcagtggacagtggatcgtgggactagtactttcactctcaccatcagcagtctgacaactgagtatttgactaactactatgtacaacgtaggttacacgtacccgtatacgtttggaccgtaaggggaccaaaggcgtaggacgtactaaccgaaacgtaatggtacgctacgcactactcttcg

SEQ ID NO: 331294 - DNA, 570 bp, Homo sapiens
  misc_feature: GZ8MTXP02F4VYW.17.57.F02.1.454.CMB.2.raw
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccaggaaacgcccctaaatcctgatctatactgcatcctaatttgacaaaggtcgggtaccatcaaggttcagtggcagtggatcgtgggactagtattcactctcacatcagcagtctgacaacctgagtatttgactaaacttactactcgtacaaacgtagggttaccacgttaccccgtacttacgttttcggacccgtaagggggaaccaaaggccgttaggggaaactaacgttaaccgaaaaaccgtaacgtggttacgggccttacggacctaaccgatttccttacggttacctttcc

SEQ ID NO: 331295 - DNA, 552 bp, Homo sapiens
  misc_feature: GZ8MTXP02H8PV8.17.57.F02.1.454.CMB.2.raw
tcagcgtagactagcacgaccggtgctcgatttagctcgatatagttgggtttgggggcaggagtcagtctcagtcaggacacagcatggacatgagggtcccccgctcagctcctggggctcctgctactctggctccgaggtgccagatgtgacatccagatgacccagtctccatccctccctgtctgcatctgtaggagacagatcaccatctcttggccgggacaagtcagagctattagactaaactttttaaatggtatcaggacggaacaggaacgccctaaactctgatctatactgactatctaattgactaaaggtcgggtacccatacgtaaggttcaggtggacaggtggatcgtagggacagtactttcactcctacactatcagctagtctagacctaactggtagtattttcgactactttactactgtacaacgtaggtacacgtacccgtatacgttcggaccgtacgggacctaggcgtagggaactacgtaactaaacggacgtcggtcggactcgacacctattccgttcg

SEQ ID NO: 331296 - DNA, 511 bp, Homo sapiens
  misc_feature: GZ8MTXP02JIP6T.17.57.F02.1.454.CMB.2.raw
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (331)..(331): a, c, t, g, unknown or other
  misc_feature (331)..(331): n is a, c, g, or t
  modified_base (503)..(503): a, c, t, g, unknown or other
  misc_feature (503)..(503): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctcttgccggnaagtcagngcattagcaacttttaaatggtatcagcgggaacagggaaacgcccctaaactcctgatctatactgcatccaattgcaagtggtccatcagtcagtgcngtggatcgtaggacagtatttcactctcaccatcagcagtcctgactaactgagtatttcgactacttacacttgtacaacgtacggttacacgttaccctagtacgtttcggacctaggggacctaaggcctggacgtactaacgaactaacgtgtacggactcgacaccngttctacg

SEQ ID NO: 331297 - DNA, 570 bp, Homo sapiens
  misc_feature: GZ8MTXP02HAC25.17.57.F02.1.454.CMB.2.raw
  modified_base (226)..(226): a, c, t, g, unknown or other
  misc_feature (226)..(226): n is a, c, g, or t
  modified_base (417)..(417): a, c, t, g, unknown or other
  misc_feature (417)..(417): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctggccgggnaagtcagagcattagctaaacttttaatggtatcagcgggaaaccagggaaacgcccctaaactcctagactctaatactgctatcctaatttgacgtaaaggtcggggtaccccagtacgtaaaggttcaaggttggactaggtgggatcgtggggactagtactttcactctacaccatcagcagtccngacaacctgaggtatttgactaacttactactgtacaacgtagggttaccacgtaccctacgtacgtttcggaccgtaggggacccaaggtcgtagggaactacgtacgaaaacgtaaccgtggtacgaccgtcgacctacctagttcttacg

SEQ ID NO: 331298 - DNA, 603 bp, Homo sapiens
  misc_feature: GZ8MTXP02GX7BT.17.57.F02.1.454.CMB.2.raw
  modified_base (200)..(200): a, c, t, g, unknown or other
  misc_feature (200)..(200): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatcgacccagtcctccatccctccctgtctgcatctgtagganacagagtccaccattctcttggccgggacaagtcagagctaattagacttaaacttttaaatggtatcgaggacgggaaaccaagggaaaccacccctaaactcctagacttactatactgactactacctaagtttcgaacgtaaacggtcgggtacccaagttacgaaacggttcaggtggacgtaggtggacgtcggtagggactagtactttcactctacacatcagtcactcgacgacctacgtgtaaggttatttacgaacttaacttactacgttcgaacgtaacgttacggtacctaaccgttacccgtagtacgttcggaccgacgggacaaggtcgaggatacgtaacaaacgtactggtacgctacgacctactacgtctacgttcttaccg

SEQ ID NO: 331299 - DNA, 531 bp, Homo sapiens
  misc_feature: GZ8MTXP02IQSL7.17.57.F02.1.454.CMB.2.raw
  modified_base (489)..(489): a, c, t, g, unknown or other
  misc_feature (489)..(489): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagactgagtcaccattctcgttgccgggcaagtcagagcattagacttaacttttaaattggtatcgagacgggaaccaagggaaacgcccctaaactcctagatctatactgctatcctaatttgactaaaggtcggggtcccatcgtaacggttcagtgcagtgatcgtgggacagtattcactctcaccatcagcagtcagaccactgagtatttcgacttaacttactacttgtaccaagtacggtactaccgtacccgtactagtttcggacgaggacagcgtgacanacgaacgacgtgtacgaacgtcgactacgtatctcgtacttc

SEQ ID NO: 331300 - DNA, 531 bp, Homo sapiens
  misc_feature: GZ8MTXP02FI1WY.17.57.F02.1.454.CMB.2.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaacttttaaatggtatcagcggaacagggaaacnccctaaactcctagatctatactgcatccaatttgactaaagtcggggtccatcaagttcagtggcagtgatcgtgggacagtattcactctcaccatccagcagtctgaccaacctgagtatttgactaacttactactgtacaacgtagggttacacgttaccccctacgtacgtttcggaccgtagggggacctaaggcgtaggagactaacgaaaccgtatcgtaggaactgaccacctatctcgtctttaccg

SEQ ID NO: 331301 - DNA, 512 bp, Homo sapiens
  misc_feature: GZ8MTXP02FUXRS.17.57.F02.1.454.CMB.2.raw
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatgtatcagcggaaccaggaaacncccctaaancctgatctatactgcatccaaatttgacgtaaagtcggggtacccatcaaggttcagtggcagtggatcgtgggactagtatttcactctcaccatcagcagtctgcaacgtgagtatttgactaacttactactgtacaaacgtaggttaccacgtaccccgtatacgtttcgaccgtagggacacgactggacatacaaacgtactgtagctgacactatctgtacttc

SEQ ID NO: 331302 - DNA, 545 bp, Homo sapiens
  misc_feature: GZ8MTXP02FPKGA.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagactaaacttttaaattggtatcgagacgggaaccagggaaacgcccctaaatcctagatctatactgcatccaatttgacaaagtcggggtaccatctaaggtcagtggcagtggatcgtagggacagtatttcactctcaccatcagcagtctgacaacgtagacggttatttcgactaacttactactagtactaaacgagggttaccacgttacccgtactacgttttcggaccgtacggggacaagcgtaggaacgacgtaacaaacgtaacgtggtcgtacgcgtacactactcgttcg

SEQ ID NO: 331303 - DNA, 869 bp, Homo sapiens
  misc_feature: GZ8MTXP02GSJSZ.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctcttggccgggnaagtcagagcattagacttaaactttttaaatggtatacgaggaccgggaaaccgaaggggaaaccgaccccttaaactccgtagtactactaatactagacctaacttaccctaaattttacggaaccgtaaaacgggttccgggggtacccctaacgttaccggtaaacggggtttaccgaagggttacggggacgtaacgggttgggggtaacttaccggggttaaggggggaaacccttaaacggggtttaacttttacccgtaacccgtttacccgttaaacccaaacccgtaacttaccgaacggtacccgttaacggttacccgtacggtaaaccccgtaaacccggttagggtaaaccgggtttaatttttaccgggaaaccctttaaaaccgttttaaccttaaaccggttacgtttaacccgtaaaaacccggtttacgggggtttaaaccccttaaaccgggttttaaacccccccggttaaacgtttaacccgggtttttaccggggaaccccgggttaaaccggggggaaacccctaaaggggttacccgttaagggaaacggtaaccgtaaaccgtaaaacggtaacgtcggttacgaccgttacggaccctaaccgtacttcgtttcg

SEQ ID NO: 331304 - DNA, 665 bp, Homo sapiens
  misc_feature: GZ8MTXP02F7S1M.17.57.F02.1.454.CMB.2.raw
  modified_base (200)..(200): a, c, t, g, unknown or other
  misc_feature (200)..(200): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtcctccatcctccctgtctgcatctgtagganacagagtcaccatctcgttggccgggcaagtcagagctattagacttaaacttttaaattggtaatcaggacggaaaccaagggaaacacccctaaaactcctagatctatactcgactactaccctaatttcgacgtaaaacgggttcggggtaccctaagtacgtaacgggttacaggtggactaggtaggacttcggtagggaactagtactttcaactctaccacatacagctagtctagacctaaacgtggaaggttactttacgaaccttaaactttaacgtacgttacgtacgtaaaacggtaacgggtttaaaccctaaccggttaaccccgttaacgtttaacggttttcggaacccggtaaacgggggaaccctaaggtccggttaaggaagtaaacttaaccgaaaacgtacgtcggtacggcgtacgacctaccgtatcttcgtacctttacc

SEQ ID NO: 331305 - DNA, 609 bp, Homo sapiens
  misc_feature: GZ8MTXP02F6U9T.17.57.F02.1.454.CMB.2.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcctctcggccgganagtcagagactatagacttaaattttaagtggtatcgaggaccgggaacgagggaaacctacccctaaactccgatactctatactcgactactacctaagtttcgaacgtaaacgggtcggtacctagtacgtaaggttcaggtgacgaggtggatcggtagggactagttactttccactacctacaaccatacgagtctagtctacgacctacgtagtagttactttcgaaccttaacttactacgttacgtaactaaacggttaggttaccctaaccggttaaccccgtagttaccgtttcgggaccggtaacggggaccaggtcgtaaggactaacgtaaacgaaacgtacgtgtcgacgtcgactactctcgttc

SEQ ID NO: 331306 - DNA, 543 bp, Homo sapiens
  misc_feature: GZ8MTXP02J1HVV.17.57.F02.1.454.CMB.2.raw
  modified_base (276)..(276): a, c, t, g, unknown or other
  misc_feature (276)..(276): n is a, c, g, or t
  modified_base (399)..(399): a, c, t, g, unknown or other
  misc_feature (399)..(399): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctctgccggcaagtcagagcattagctaaacttttaaatggtatcagacggaaccagggaacncccctaaatcctgatctatactgcatcaatttgactaaaggtcgggtaccatacgtaaggttcaggtggcaaggtggatcgtagggacagtactttacacttcctacacctatccagcagtcngacaacgtgagtatttcgactaactttcactacgtactaaacgagggtttacacggttacccctataccgtttggaccgtacgggaccaaggcgtaggacgactaaccgaaacgtactggtacggctacgacctaccattctcg

SEQ ID NO: 331307 - DNA, 549 bp, Homo sapiens
  misc_feature: GZ8MTXP02JL8BK.17.57.F02.1.454.CMB.2.raw
  modified_base (224)..(224): a, c, t, g, unknown or other
  misc_feature (224)..(224): n is a, c, g, or t
  modified_base (275)..(275): a, c, t, g, unknown or other
  misc_feature (275)..(275): n is a, c, g, or t
  modified_base (378)..(378): a, c, t, g, unknown or other
  misc_feature (378)..(378): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatctcttgccggnaagtcagagcattagctaactttttaaatggtatcagcggaacaggaaacncccctaaactcctgatctatactgcatccaatttgactaaagtgggtccatcgaaggttcagtgacagtggatcgtgggactagactttcactctacaccatnagacagtctgacctacgtgagttatttgactaactttactatgtacaaacgtaggttaaccacgttaaccccgtgttacgtttggacccgtaagggggtacccaaaggtcctaaggggacacgtaaccgaaacgtaacgtggttacggacctacggaccacctatcttacg

SEQ ID NO: 331308 - DNA, 512 bp, Homo sapiens
  misc_feature: GZ8MTXP02INRY8.17.57.F02.1.454.CMB.2.raw
  modified_base (273)..(273): a, c, t, g, unknown or other
  misc_feature (273)..(273): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggcaaggtcagagcattagctaacttttaaatggtatcagcggaaccagggaaancccctaaatcctgatctatactgcatcctaatttgacaaagtggggtcccatcaaagttcagtggcagtgatcgtgggacagtatttcactctcaccatcagcagtctagcaactgaaagttnttanactaatactatgtacaacgtagtacacgtacctatacgttcgacgacggacagcgtagactataacgaaacgtacgtgacgaactacgacctacgtacttccttagttctac

SEQ ID NO: 331309 - DNA, 512 bp, Homo sapiens
  misc_feature: GZ8MTXP02FSCSZ.17.57.F02.1.454.CMB.2.raw
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (289)..(289): a, c, t, g, unknown or other
  misc_feature (289)..(289): n is a, c, g, or t
  modified_base (476)..(476): a, c, t, g, unknown or other
  misc_feature (476)..(476): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggnaagtcagagcattagctaattttaatgatcagcggaacaggaacnccctaaatcctagatctatactnacataccaaatttgactaaaggtcgggtaccatacgaaggttcagtgactagtggatcgtagggacagtactttcaactctacacatcagcagtctgacaacgtgagtatttgactaacttactactgactaacgtaggttaaccacgtacccctatacgtttggacgaagggacaagctaggatanactaaacgactgtacgctcgaccacatctcgtctac

SEQ ID NO: 331310 - DNA, 515 bp, Homo sapiens
  misc_feature: GZ8MTXP02GFKWU.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaacttttaaatggtatcagcggaaccagggaaacgcccctaaactcctgatctatactgcatccaatttgacaaagtgggtccatcaaggttcagtgcagtggatcgtgggacagatttcactctcaccatcagctagtctgcaactgagtatttgactaacttactactgtacaaacgtagggttacacgtaccccgtatacgtttggaccgtaaggggaccaaggctaggacgacgtacgaaacgactgtcggctacgaccacactctcg

SEQ ID NO: 331311 - DNA, 811 bp, Homo sapiens
  misc_feature: GZ8MTXP02GR9AF.17.57.F02.1.454.CMB.2.raw
  modified_base (198)..(198): a, c, t, g, unknown or other
  misc_feature (198)..(198): n is a, c, g, or t
  modified_base (279)..(279): a, c, t, g, unknown or other
  misc_feature (279)..(279): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttggccgggcaagtcagagcattagctaacttttaaatggtatcaggacgggaaccagggaaacncccctaaactcctagactctaatactgactactacctaaattttcgaactaaaagggttcggggtacccctaagttaccgtaaagggtttccaaaggttcgggaccgtaggtacgggtaacttcggtacgggggaacctaaggttaacttttccaaacctttccgttacccaaaccccgtattacccgaaggaccctaaggtttcccttacggacccctaaaaccgttgggtaaaacgggttatttttacggaaaccctttaaaaccgttttaccttaaaccgtttaggtaacccgtaaaaccggttaacgggggttttaaaaccccaaccgggtttaacccccccgttaaagttaaacccgggtttttcgggaaaccccgggtaaacgggggtaaaccccctaaaagggcccggtttaaaggggaaaccgtaaacttaaaccggaaaaacccgtaaacggtttggtaaacgggggccgttacgggtaacccaaaaccccgttacgtttaccgtttacgtttacctttaccg

SEQ ID NO: 331312 - DNA, 603 bp, Homo sapiens
  misc_feature: GZ8MTXP02GIVMT.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaacttttaatggtatcagcggaacaggaacgccctaaactcctgatctatactgctatccaatttgactaaaggtcgggtacccatacgaaggttcagtggacagtggatcgtagggacagtactttcactctacacctataccagctagtcctagacctaaccgtgaaggttacttttcggacttaaactttactacgttagtacaaacgtacgggttaacaccggttaaccccgttataccgttttcggacccgtaacgggggtaccctaaaggtaccgtagggaaactacgttaaaccgaaaacggtaaccgttggtaacgggtcttacggacctaacccgagtttaccgtttaccg

SEQ ID NO: 331313 - DNA, 553 bp, Homo sapiens
  misc_feature: GZ8MTXP02I5AYA.17.57.F02.1.454.CMB.2.raw
  modified_base (273)..(273): a, c, t, g, unknown or other
  misc_feature (273)..(273): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggcaagtcagagcattagctaaacttttaatggtatcagcggaaccagggaaacncccctaaactcctgatctatactgctatccaatttgactaaaggtcggggtcccatcaaggttcaggtgcagtggatcgtgggacagtatttcactctcaccatccagcagtctagcaacgtgagtatttgacctaacttactacgtgtaccaagtaacgggttaccacgtaccccgttatacgtttggaccgtaggggtaccaaggtcgtagggaactacgacgaaaaccgtacgtgtacggtctacgacctaacccttgttccgttacgttccttacg

SEQ ID NO: 331314 - DNA, 574 bp, Homo sapiens
  misc_feature: GZ8MTXP02H83SO.17.57.F02.1.454.CMB.2.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcaccatctcttggccgggnaagtcagagctattagacttaacttttaaatggtatcaggacggaacagggaaacncccctaaatcctagatctatacngcatcctaatttgacaaaggtcgggtacccatcaaacggttcagtggactaggtggatcgtgggaactagtactttcactctacacatcagcagtctgacaaccgtgaacggttatttacgaccttaaactttactactagtactaacgtagggttaacctaccgttaaccccgtacttacgtttacggaccgtaaggggaaccaaggcgtaggacaactaacgaaacgtacgtggtacggtctacgaccacctattcctcgtttactcc

SEQ ID NO: 331315 - DNA, 561 bp, Homo sapiens
  misc_feature: GZ8MTXP02FXZXT.17.57.F02.1.454.CMB.2.raw
  modified_base (198)..(198): a, c, t, g, unknown or other
  misc_feature (198)..(198): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctggtagganacagagtcaccatctcttgccgggcaagtcagagcattagactaaacttttaatggtatcgaggacgggaaccaagggaaacgacccctaaactcctagactactatactgactatacctaatttgacgtaaaggtcgggtacctagtacgtaaggttacaggtcggacgtaggtggatcgagggacagtattcactcacacatacagctagtctagacctaacgtgagttactttcgaacttaaacttactactgtactaaacgtacggttacacgttaccctatacgttcggacgtacgggacaagtcgagacaactacgaaacgtactcggtacgctcgacctactactctacgtcttac

SEQ ID NO: 331316 - DNA, 586 bp, Homo sapiens
  misc_feature: GZ8MTXP02HSQ4A.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccggnaagtcagagcattagctaaactttttaaatggtatcaggcgggaaaccagggaaacgcccctaaactcctgatctatactgcatccaatttgactaaaggtcggggtacccatcgaaggttcaggtggcaggtggatcgtagggactagtatttcactctacacccatccaagcctagtctgacaattctaggaggttatttttgacttaaacttactacgtcgtacgaaacgtaggggttacaacgtacccccggttataaccgtttcgggacccgtaaagggggtacccaaaggtcgttaggggacgtaacttaccgaaaacgtaacgttggtacggtacctcgacccacgtacgtttcc

SEQ ID NO: 331317 - DNA, 518 bp, Homo sapiens
  misc_feature: GZ8MTXP02G0OH6.17.57.F02.1.454.CMB.2.raw
  modified_base (227)..(227): a, c, t, g, unknown or other
  misc_feature (227)..(227): n is a, c, g, or t
  modified_base (290)..(290): a, c, t, g, unknown or other
  misc_feature (290)..(290): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggnaagtcagagcattagctaacttttaaatggtatcagcgggaaccagggaaagcccctaaaacncctgatctatactgcatccaatttgacaaaggtcggggtaccatcaaggttcagtggcagtggatcgtgggacagatttcactctcaccatcagcagtctgacaacctgaggtatttgactaactttacactgtacaaactaggttaacacgtaccccgtactacgtttcgaccgtacgggaccaaagcgtaggacgactacaaacgaactgtagctcgcaccatctg

SEQ ID NO: 331318 - DNA, 544 bp, Homo sapiens
  misc_feature: GZ8MTXP02I9ICV.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaactttttaaattggtatcgaggacgggaaccgaagggaaacgcccctaaaactcctagactactatactgcatcctaatttgacaaagtcggggtccatcaaggtcagtgacagtggatcgtgggacagtatttcactctcacctatcagcagtctgacacgtagagtatttgactaacttatacctgtacaacgtacggttaacacgttaccccgtatacgtttcggaccgaacggggacctaaggcgtaggaacgactaacgaaacgaactggcggctacgccacgtacttacgttc

SEQ ID NO: 331319 - DNA, 380 bp, Homo sapiens
  misc_feature: GZ8MTXP02IND36.17.57.F02.1.454.CMB.2.raw
  modified_base (352)..(352): a, c, t, g, unknown or other
  misc_feature (352)..(352): n is a, c, g, or t
  modified_base (376)..(380): a, c, t, g, unknown or other
  misc_feature (376)..(380): n is a, c, g, or t
tcagcgtagactagcacgaccggtgctcgatttagctcgatatagttgggtttggggtacgatttggtgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacagatataacctgttccatcgactacgcctttcggcctcgccttagggtcgactcaccctgccccgattacgtgacaggaccttggtctcggngagcgggctggcaaggcgcatagnnnnn

SEQ ID NO: 331320 - DNA, 527 bp, Homo sapiens
  misc_feature: GZ8MTXP02GPB7Z.17.57.F02.1.454.CMB.2.raw
  modified_base (484)..(484): a, c, t, g, unknown or other
  misc_feature (484)..(484): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatggtatcagcggaaccagggaaacgcccctaaactcctgatctatactgcatccaatttgacaaaggtcggggtcccagtcaacggttcagtggacaggtggatcgtgggacagtatttccactctacacatcagcagtctgctaactgacgtattttacaactttactactagtacaaacgtacgggttaacacgttacccctatacgtttggcctaggggaccaagctagganactacaaacgtaactgtggactgacactactctcgttctctac

SEQ ID NO: 331321 - DNA, 557 bp, Homo sapiens
  misc_feature: GZ8MTXP02FW0BV.17.57.F02.1.454.CMB.2.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctctggccggnaagtcagagcattagactaacttttaaatggtatcgagacggaacaaggaaacncccctaaactcctgatctatactgactatcctaatttgacaaaggtcgggtaccatacgtaaggttcaagtggacaggtggatcgtagggactagtactttcaactctacaccatacagctagtctacgaccaacgtgaggttatttcgactaacgttactactatactaacgtacggtaactacgtacccgtactacgtttcggacgtaacgggaccagtcgtaggaagtactaacgaaacgaactggtacgacgtacgacctacacgttcttacg

SEQ ID NO: 331322 - DNA, 559 bp, Homo sapiens
  misc_feature: GZ8MTXP02GVMXN.17.57.F02.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (278)..(278): a, c, t, g, unknown or other
  misc_feature (278)..(278): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttggccgggnaagtcagagcattagctaacttttaaatggtatcagacggaacaggaaacncccctaaactcctagatctatactgcactacctaatttcgactaaaggtcgggtaccagtacgagttcagtggcagtggatcgtagggacagtactttcactctcaccatcgagctagtctgacctaacgtgaggttatttcgactaactttactacttgtacaaacgtacggttacacgttaccccgtattacgtttcggaccgtaacggggaccaagtccgtaggaacacgtaacgaaacgtacgtggtacgacgtacgacctacgtacgttactttcg

SEQ ID NO: 331323 - DNA, 775 bp, Homo sapiens
  misc_feature: GZ8MTXP02H5Z6H.17.57.F02.1.454.CMB.2.raw
  modified_base (201)..(201): a, c, t, g, unknown or other
  misc_feature (201)..(201): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgaccccagtcctccatccctccctgtctgcatctgtagganacagagtcaccatctctggccgggcaagtcagagcattagactaacttttaaatggtaatcgagacggaaccgaagggaaacgacccctaaactcctagatctatactgactatacctaatttgacgtaaacggtcggggtaccccaagttacgaacggtttccaagggttgggaccgtaggttacgggtaactcggttacgggggtaacctaaagggttattttacccgaaccttccttaacccaaaccccgtaattaccgtaacggacctaaacggttccgttacgggtaccctaaaacccggttgggaaaaccgggtttttacgtttaaccgtaaacctttaaaacctttaaaccgttaccgtaacgttaaacccgtaaaccgggtaaccgggttaaacccgtaaacccggttaacccccgttaaccgttaaccggtttaccgggaaccggtaaaccggggtaaacccgtaacggtacggtaaacggaaacgtaaacgtaaaccgtaaaacgtaacgttcggtacgtaacgtaccgaacctaacctacgttaccgttacgtttaccttacg

SEQ ID NO: 331324 - DNA, 567 bp, Homo sapiens
  misc_feature: GZ8MTXP02IZAGB.17.57.F02.1.454.CMB.2.raw
  modified_base (196)..(196): a, c, t, g, unknown or other
  misc_feature (196)..(196): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaganacagagtcaccatctcttgccggcaagtcagagcattagacttaaacttttaatggtatcaggacggaaccaagggaaacacccctaaactctagatactatactgcatacctaatttcgacaaaggtcgggtacccaatacgaacggttcagtgctaggtgatcgtggacagtnttcactctacaccatcagcagtcncgactaactgaagttatttcgactaactttactacttcgtacaacgtaggttacctacgttacccgtacgttacgtttcggaccgtacgggaacaacgtcgtaggaacgtaacgtaaccgaaaccgtagtacggtacggcttagacctacgtactccttacgttacctttcg

SEQ ID NO: 331325 - DNA, 679 bp, Homo sapiens
  misc_feature: GZ8MTXP02HOYBR.17.57.F02.1.454.CMB.2.raw
tcagcgtagactagcacgaccggtgctcgatttagctcgatatagttgggtttgggggcaggagtcagtctcagtcaggacacagcatggacatggagggtccccgctcagctcctggggctcctgctactctggctccgaggtgccagatgtgacatccagatgacccagtcctccatccctccctgtctgcatctgtaggagacagagtccacctatcctcgttcggccgggcaagtcagagactattagacttaacttttaaagtggtaactacgacggaccggaaaccgaacgggtaaaccgtacccctaaactcctagtactactaatactgactacttacctaagtttcgaacgtaaacgggtccgggtacctacgtacgtaacggttacgaggtggacgtaggtcgggtacgttacggtacggggtactaaggttacttaccgacttaccctacctaaccgtataccgaagtaccgtacgtaccgtacgaacccgtaaccgtagtacgttacgttttacaaccttaaccgtttacttacgttacgtacgtaaacggttaccggttaacctaaccgttacccgttacgtacggttacggaccggtacggaactagacgtaggactacgaactaaccgagtcgacgacgttaccgactacctacttcgttaccc

SEQ ID NO: 331326 - DNA, 640 bp, Homo sapiens
  misc_feature: GZ8MTXP02JYQTM.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttggggggagtcagtctcagtcaggacacagcatggacatgagggtcccccgctcagctcctggggctcctgctactctggctccgaggtgccagatgtgacatccagatgacccagtctccatcctccctgtctgcatctgtaggagacagagtcaccatctcttggccggganaagtcagagctattagacttaaacttttaatggtatcgaggaccgggaaaccgaagggaaaccgacccctaaactcctagatctatactgctactacctaagtttgacgtaaaggtcggggtaccctagtacgtaacggttcaggtggactaggtacggtatcggtaggggtactaaggttactttcacttcctacaaccctatcgagctaacggtctacgacctaaccgtggtacggttattttacgaaccttaactttacgtacgtcgtaaccaaacggttacgggttacctaaccgttaaccccgtacttaccgtttacgggaccgtaacggggaccctaaggtcgtaggaacgtacgtaacgaaaacgtacgtggtacgcgtacgactaccgtacttcgtacgtcttacc

SEQ ID NO: 331327 - DNA, 551 bp, Homo sapiens
  misc_feature: GZ8MTXP02GPFGS.17.57.F02.1.454.CMB.2.raw
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctcttgccggcaagtcagagcattagctaaactttttaaatggtatcgaggacgggaaccagggaaacgcccctaaactcctagatctaatactgctatccaatttcgacaaaggtcggggtacccagtacaaacggtttcaggtggcagtgggaatcgtaggggactagtactttcacttctcaccatcanctagtcctgaccaaactgagtatttcgactaactttanactgtacaacgtaggttacacgtaccccgtatacgtttcgaccgtacgggaccagtccgtaggaactactacgaaaccgtaatggtacgctaggacctacgatccttg

SEQ ID NO: 331328 - DNA, 536 bp, Homo sapiens
  misc_feature: GZ8MTXP02GGORI.17.57.F02.1.454.CMB.2.raw
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaattttaatggtatcagcggaacaggaaacgcccctaaatcctgatctatactgcatccaatttgacaaagtggggtccatcaaggttcagtgcagtggatcgtggacagatttcactctcacatcagcagtctagcaaactgagtatttgactaacttactactgtacaaacgtagggttaaccacgttacccccgtatacgtttcggaccgtaagggggaccctaaagcgttaggaacgtactaacgaaaaccgtaactggacggctacgacacctaagtcttacgtcctttacc

SEQ ID NO: 331329 - DNA, 573 bp, Homo sapiens
  misc_feature: GZ8MTXP02GJAID.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccgggcaagtcagagcattagctaaacttttaaatggtatcgagcgggaaaccagggaaacgcccctaaactcctagactctatactgcactccaagtttgacaaaggtcggggtacccataccgaagttcaggtgcagtggatcgtggacagtatttcactctcaccatacagcagtctgcaaccgtagagtatttagactaacttactactcgtactaacgtagggttacacgttaccccgtactacgttttcggaccgtaacggggaacctaacgtcgttagggaaacgtaacgtaaaccgtaaaacgtaaacgtcggtacggtactacgaccgaacctacgttacgttcg

SEQ ID NO: 331330 - DNA, 511 bp, Homo sapiens
  misc_feature: GZ8MTXP02GU7J6.17.57.F02.1.454.CMB.2.raw
  modified_base (270)..(270): a, c, t, g, unknown or other
  misc_feature (270)..(270): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatctcttgccggcaagtcagagcattagctaacttttaatggtatcgagcggaacaggaaacncccctaaatcctagactctatactgcatcaatttgacaagtcgggtccatcaagttcagtgcagtggatcgtgggactagtactttcactctacacntcagcagtcngacacgtgagttattgactaacttactatgtacacgtacggttacacgtacccctatacgtttcgacgagggtaccagcgtaggaactacgtaacaacgtactgtacgctacgactaccattctcgtactttcc

SEQ ID NO: 331331 - DNA, 573 bp, Homo sapiens
  misc_feature: GZ8MTXP02H6N7S.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttgggtttggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagatcaccatctcttggccgganaagtcagagcattagctaacttttaatggtatcagcggaacaggaacgccctaaactcctgatctaatactgactatacctaatttgacgtaaaggtcggggtacccagtacgtaaggttcaggttggacaggtggaattcgtgggacagtactttcactcctacaccatacagctagtctagacctaaccgtgaaggttattttaggaacctaaactttacctagtacgtaaccgaaacgtaacgggttacctaaccgtaccccgttaactacgtttcggaccgtaggggaacctagacgtaggacgataaccgaagtaacgtgtacgctacgacctaccgattctcg

SEQ ID NO: 331332 - DNA, 730 bp, Homo sapiens
  misc_feature: GZ8MTXP02HJFCT.17.57.F02.1.454.CMB.2.raw
  modified_base (204)..(204): a, c, t, g, unknown or other
  misc_feature (204)..(204): n is a, c, g, or t
tcagcgtagactagcacgaccggtgctcgatttagctcgatatagttgggtttgggggagtcagtctcagtcaggacacagcatggacatggacgggtcccccgctcagcctccgtggggctcctgctactctggctccgaggtgccagatgtgacatccagatcgacccagtcctccatcctccctgtctgcatctgtagganacagagtccacatctcgttggccggcaagtcagagctaattagacttaacttttaaatggtatcgaggaccgggaaccagggaaacgtacccctaaactcctagattctatactagctaatacctaaatttcgacgtaaaagggtcggggtaccccaagttacgtaaacgggttccaagggttcggactaagggtgggtacttccggggtaggggtaactaaggttactttccgaaaccttcctacccgaaacctactaccgtaacgctaacgttccgttacggaccctaaaccgtaggtaaggttacttttacggaaaccttaaactttaaacctacgtttacggaacctaaacgggtaacgggttaacctaaccggttaaccccgtaacgttaccgtttacggaccgggtaaacggggaaccccaaaagggtccgttaggggaataaacttaacccggaaaacgtaaccgttggtaacggccttacggacctaccgtaacttccggtacgtttacctttacccg

SEQ ID NO: 331333 - DNA, 559 bp, Homo sapiens
  misc_feature: GZ8MTXP02IL1OS.17.57.F02.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcaccatctcttgccgggnaagtcagagcattagctaactttttaaatggtatcagacggaacaggaacacccctaaactctagatctatactgctatcctaaatttcgaacaaaggtcggggtacccaagttaccgaaaggttcaggtaggacgtagtggggatcgtgggactagtatttcacgtctacacctatacagtcagtctgactaacctgaagtactttgactaaactttactacttatacgaacgtagggttacaacgttacccgtactacgtttcggacgtacggggaccaagctaggaacacgtaaccaaagtactggtagctacgactacgtaacttcgtc

SEQ ID NO: 331334 - DNA, 534 bp, Homo sapiens
  misc_feature: GZ8MTXP02HRPXF.17.57.F02.1.454.CMB.2.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (382)..(382): a, c, t, g, unknown or other
  misc_feature (382)..(382): n is a, c, g, or t
  modified_base (510)..(510): a, c, t, g, unknown or other
  misc_feature (510)..(510): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttggccggnaagtcagagctattagacttaaattttaatggtatcgagacggaacaggaaacnccctaaatctgatctatactgacatacctaatttgactaaaggtcgggtaccagtcaagttcagtgactagttgatcgtagggactagtattcactctaccacatnagacagtctacgcaacgtgagtatttgactactactactagtacaacgtaggtaacacgttacccgtactacgtttagccgtaacgggaccaagcgtagaagtacaacgaaaacgacgttagcggtcncgactaacacttactcgttctacc

SEQ ID NO: 331335 - DNA, 529 bp, Homo sapiens
  misc_feature: GZ8MTXP02GTFLO.17.57.F02.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (368)..(368): a, c, t, g, unknown or other
  misc_feature (368)..(368): n is a, c, g, or t
  modified_base (518)..(518): a, c, t, g, unknown or other
  misc_feature (518)..(518): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggnaagtcagagcattagctaaactttttaaatggtatcaggacggaaccaggggaaacgcccctaaactccagatctatactgcatccaaatttgactaaaggtcggggtcccatccaaggttcagtggactagtggatcgtgggacngatttcactctcacatcagcagtctagcaacgtgaggtatttgactattacactgtacaacgtaggttacagttaccccgtatacgtttggaccgagggacctagcgtaggctaactcgaaaacgtacttggacgaacgtcactaacctntactcgtcctc

SEQ ID NO: 331336 - DNA, 532 bp, Homo sapiens
  misc_feature: GZ8MTXP02FRJO2.17.57.F02.1.454.CMB.2.raw
tcagcgtagactagcacgaccggtgctcgatttagctcgatatagttgggtttggggggaggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaactttttaaattggtatcaggacgggaaccagggaaacgacccctaaactcctgatctatactgcactccaaatttgacgtaaaggtcggggtacccatacgaacggttcaggtggcaggtggatcgtgggacagtatttcactctcaccatcagcagtctgactaactgagttatttgacctaacttactactgtacaacgtaggttaccacgtaccccgtactctttggaccaggggaccaagctaggacatacaaacgactgacggctgacaccatctcgtcttacg

SEQ ID NO: 331337 - DNA, 531 bp, Homo sapiens
  misc_feature: GZ8MTXP02FZOUH.17.57.F02.1.454.CMB.2.raw
  modified_base (223)..(223): a, c, t, g, unknown or other
  misc_feature (223)..(223): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggnaagtcagagcattagctaacttttaaatggtatcagcggaaccaggaacgcccctaaatcctgatctatactgcatcctaatttcgactaaaggtcggggtaccctagtcgaacggttcagtggctagtggatcgtgggacagtattcactctcacatcagcagtctgcaactgagtattgactacttactactgtacaactaggttaccacgtacccgtatacgtttggaccgtaggggacctaaggcgtaggactagtaccgaaacgtaacgtgacggtctacggaccactagtcgtactctttac

SEQ ID NO: 331338 - DNA, 647 bp, Homo sapiens
  misc_feature: GZ8MTXP02FQODQ.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgaccagtctccatcctccctgtctgcatctgtaggagacagagtcaccatctctgccgggnaagtcagagcattagctaacttttaaatggtatcagcggaaccagggaaagccccctaaactcctgatctatactgcataccaatttgacaaaggtcggggtaccatccgaaggttcacgtggcagtgatctaggggacagtatttcactctcaccctatacagctacggtctacgacctaaaccgtgtaacgggttactttttacggaacttaaaacctttactaacctttaggtaacctaaaaccgtaacgggggtttaacctaacccgggttacccccgttaaacgttaaccgtttttcgggaacccggttaaacgggggaacccctaaggtaccgttgggaaacgtaacgttaaccgaaaaccggtaaacgtggtaacggtacccgttacggacctaaacccgacgttacctttaccgg

SEQ ID NO: 331339 - DNA, 514 bp, Homo sapiens
  misc_feature: GZ8MTXP02JX6IE.17.57.F02.1.454.CMB.2.raw
  modified_base (493)..(493): a, c, t, g, unknown or other
  misc_feature (493)..(493): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggcaagtcagagcattagctaacttttaaatggtatcagcggaacagggaaacgcccctaaactcctgatctaatactgacatccaatttgactaaaggtcgggtccatcaagttcagtgcagtgatctgggacagatttcactctcaccatcagctagtctgacaaccgtgacgtatttgactaacttactactgtacaacgtaggttacacgttaccccgtatacgttttggctaaggggaccaaggctaggagtactacaaacgtacngtaggctacgccactctctcg

SEQ ID NO: 331340 - DNA, 675 bp, Homo sapiens
  misc_feature: GZ8MTXP02H8XCZ.17.57.F02.1.454.CMB.2.raw
  modified_base (197)..(197): a, c, t, g, unknown or other
  misc_feature (197)..(197): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctagtagganacagagtcacatctcgttcggccggacaagtcagagctaattagacttaaacttttaaatggtaatcgaggaccggaaacgtaagggaaaccacccctaaaactcctagacttacctaatacctgactaatacctaaatttgacgtaaaggtcgggtaccagtacgtaaaggttcaggtacgactaggtaggtacttccggtaggggaaactaagggttactttaccgaaccttaccgttacccaaacccttaaacgtacgtaacgtaccgtacgtaccgtacgaacctaaacggttaggtaacggtttactttacgaacttaaactttaacgtaacgtacgtaacgtaacggtaacgttaaccgtaacccgttaacccgtagttacggttacggaccgaacggacgtaacgcgtagaactaaacgtaaacgaaacgtacgtagacgtaacgtacgacctactactcctacgttactc

SEQ ID NO: 331341 - DNA, 561 bp, Homo sapiens
  misc_feature: GZ8MTXP02FKUKC.17.57.F02.1.454.CMB.2.raw
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
  modified_base (493)..(493): a, c, t, g, unknown or other
  misc_feature (493)..(493): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgctttcggctcgccttaggggcgactcacctgccccgattaacgttggacaggaacccttggtcttccggcgagcgggcttttcgacccgctttatcgttacttactgtcagcattcgctctcngatacctccagcatgctcacancacacctcacagcttacagaacgctaccctaccaacacgacataacgctcgctcgccncacgcgtcgtcgctacgtcggttacgcccgtactcactcctacccgacctactctacgtactacgtac

SEQ ID NO: 331342 - DNA, 621 bp, Homo sapiens
  misc_feature: GZ8MTXP02H8YX2.17.57.F02.1.454.CMB.2.raw
  modified_base (202)..(202): a, c, t, g, unknown or other
  misc_feature (202)..(202): n is a, c, g, or t
  modified_base (326)..(326): a, c, t, g, unknown or other
  misc_feature (326)..(326): n is a, c, g, or t
  modified_base (438)..(438): a, c, t, g, unknown or other
  misc_feature (438)..(438): n is a, c, g, or t
tcagcgtagactagcacgaccggtgctcgatttagctcgatatagttgggtttggggcaggagtcagtctcagtcaggacacagcatggacatgacgggtccccgctcagctcctggggctcctgctactctggctccgaggtgccagatgtgacatccagatcgacccagtctccatccctcctgtctgctatctgtaganacagatcacatctcgtcggcggacagtcagtagctaagttacgacttaaacgtttttaaatggtactacgacggacggaaaccgaagggaaacccacccctaaacgtcctagactacgtatacngtacacttcctaattcgaacgtaaaggttccgggtacctagtacggtaacgttcgaggttcgacgtaggtgtacgtcgtaggatacgtacttctaactcgacacctatacgnactagtctacgactacgttgacgttatttacgacttaacttactagtacacgtaaacgtacggtactaacccggtaccttaacgttcgttacgggaccgtagggtaaccgagtcgtacgggaaataaccgttacgaaaacctcggttaacgaggttaccctaggaccacttacgtttacggtc

SEQ ID NO: 331343 - DNA, 632 bp, Homo sapiens
  misc_feature: GZ8MTXP02F94D9.17.57.F02.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatctctgccggnaagtcagagctattagacttaaacttttaaatggtatacgaggacgggaaaccgaagggaaaccgtacccctaaactcctagtacttactaactactgactacttacctaatttcgaacgtaaaggtccgggtaccagtacgtaaggttcaggtggactaggtggatcggtagggactagtatttccactctacaaccctatcgaatcgtaacgttcctagtaccctaaaccgttaggtaacggtttaactttttacgaaccttaaacctttacttaccgtagttaaccgaaaacggttacgggttaaccaccgtaaaccccgttagttaacgttcgggaccgtacggggaccaagcgtaggactaacacgaaacggtatcggacggtactcgacctacctagttcttc

SEQ ID NO: 331344 - DNA, 562 bp, Homo sapiens
  misc_feature: GZ8MTXP02HVJHL.17.57.F02.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (400)..(400): a, c, t, g, unknown or other
  misc_feature (400)..(400): n is a, c, g, or t
tcagcgtagactagcacgaccggtgctcgatttagctcgatatagttgggtttgggggagtcagtctcagtcaggacacagcatggacatgagggtcccccgctcagctcctggggctcctgctactctggctccgaggtgccagatgtgacatccagatgacccagtctccatcctccctgtctgcatctgtagganacagagtcacatctcttggccgggnaagtcagagcattagctaaactttttaaatggtatcgaggaccggaaaccagggaaacacccctaaatcctagatctatactgcatcctaatttgactaaaggtcggggtacccataccgtaaggttcaggtgacaggtggatcgtgggacagtactttcactctacacatcagacncgtactgaccactagaggtatttacgactaacttactacgttagtactaacgtacggttaacaccgtacccgttactacgtttcggaccgacggggacctaaggcgtaggaacacgtaacaaacgtacgtggagaacgtcgactacactcgttcgttacttc

SEQ ID NO: 331345 - DNA, 830 bp, Homo sapiens
  misc_feature: GZ8MTXP02GA68H.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggganaagtcagagctattagtactaaacttttaaatggtatcgaggacggaaccgaagggaaacacccctaaactcctagactactatactgactactacctaagtttgaacgtaaaacggttcggggtacccctaagtacgtaaacgggtttacagggttacgggataagggttaggtaacgttcgggtacggggtaaactaacggtttacttttacccaacctttcctaacccaaacctaacttacccgaagtaccgttaaaccgtttccgtaccggtaaccctaaaacccggtttagggtaaagggtttaactttttacggaaacccctttaaaaccttttaaccgtttaaacgtttaccgttaaaccgtaaaacgggttaacccggggtttaaaacccgtaaacccgggtttaaacccccggtttaaacgtttaacccgggttttacgggaaaccccggtaaagggggttaaaaccccaaggtaccgggttaaagggaaacggttaaacttaaacccggaaaaacggttaaccgtggggttaccggaacgtttaccggaacccgttaaaaccccgtttcgtttaccgttacgtttacccgttaacg

SEQ ID NO: 331346 - DNA, 530 bp, Homo sapiens
  misc_feature: GZ8MTXP02I0P66.17.57.F02.1.454.CMB.2.raw
  modified_base (225)..(225): a, c, t, g, unknown or other
  misc_feature (225)..(225): n is a, c, g, or t
  modified_base (274)..(274): a, c, t, g, unknown or other
  misc_feature (274)..(274): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctcttgccgggnaagtcagagcattagctaacttttaaatgtatcagcggaacaggaaacnccctaaactcctgatctatactgcatcctaatttgacaaagtcggggtcccatacgaaggttcagtggcagtggatcgtgggacagtatttcactctcaccatcagcagtcctgaccaacgtgagtatttgactaaacttatactgtacaaacgtaggttacacgtaaccccgtataacgtttggaccgtaaggggacctaaagctagggacacgtaacaaacgtaactggacggctacgacaccgtattcgtacg

SEQ ID NO: 331347 - DNA, 523 bp, Homo sapiens
  misc_feature: GZ8MTXP02GRR0L.17.57.F02.1.454.CMB.2.raw
  modified_base (227)..(227): a, c, t, g, unknown or other
  misc_feature (227)..(227): n is a, c, g, or t
  modified_base (280)..(280): a, c, t, g, unknown or other
  misc_feature (280)..(280): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatctcttgccgggnaagtcagagcattagctaactttttaaatggtatcagacggaacagggaaacncccctaaatcctgatctatactgcataccaatttgacgtaaaggtcggggtaccagtcgaaggttcaggtggcaggtggatcgagggacagtatttcactctcaccatcagcagtctgacaactgagtatttcgactaacgttacatgtacaacgtaggttacacgtaccctatacgtttcgacgtacgggaccaggctaggacacgtacaaacgtacgtgtacgctacgacacctagtctcg

SEQ ID NO: 331348 - DNA, 681 bp, Homo sapiens
  misc_feature: GZ8MTXP02IWKL2.17.57.F02.1.454.CMB.2.raw
tcagcgtagactagcacgaccggtgctcgatttagctcgatatagttggggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatctcttggccgggcaagtcagagcaattagacttaacttttaaattggtatcaggacgggaaccgaagggaaacgacccctaaacctctagatctatactgctatacctaatttagactaaacggtcggggtacccagtacgtaacggttcaggtcgactagttggtatcgtaggaactagtactttcacttctaccaacctataccgacgtacgtacgttcctacggaccctaaaccgtggttaaacggttatttttacgaaccttaaacctttaaccgttacttacgtaaccctaaacgggttaaccgggtttaaccgtaacccgtttaacccccggtaactttacggttttaccgggaccgtaacgggggaacctaaaacggggtcctaggggaaacgtaacgtaaccgtaaaacgtaccgtagggtcgtaacgtacggacctacctattccgtcgtttaccctttac

SEQ ID NO: 331349 - DNA, 690 bp, Homo sapiens
  misc_feature: GZ8MTXP02GWNUE.17.57.F02.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctggccggnaagtcagagctattagacttaaacttttaaatggtatcgaggacggaacaagggaaactcccctaaacgtcctagattctatactgactatacctaagtttcgaacgtaaacggtcggggtacccagttaccgtaaagggtttccgaaggttcggactaagggtcggaacttcgggtacgggaaactacggtacttttccaaccttctacccaaacctacttaccgacgtacgtacgttaccgtacggtacctaaaccgttagggtaacggtttactttacgaaacttaaacctttaacttacgttacgtaaccgtaaacggtaacggttaaaccgtaccgttaaccccgttaacgttaccggttttacggaaccggtacgggaaccgtaacgaccgttagggactaagtaaccgtaaacgtacgtggtacgaacgttacgacgtactagttacctcgttactttacc

SEQ ID NO: 331350 - DNA, 581 bp, Homo sapiens
  misc_feature: GZ8MTXP02J3HJX.17.57.F02.1.454.CMB.2.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (304)..(304): a, c, t, g, unknown or other
  misc_feature (304)..(304): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatcgacccagtcctccatccctcctgtctgcatctgtaagganacagatcaccntcctnttcggccggnaagtcaganctattagactaactttttaaatggtatcgaggacggaacaggaaacgcccctaaactctgatctatacngcactccaatttcgactaaaggtcgggtacccatccgaaggttcagtgactaggtggatcgtagggactagtactttcactctcacagtcagcagtctcgacctacgtggaaggttactttacgaccttaacttaactacgttacgtacaaacggtacggttaacccgtaccgttacccccgtacgttacggttttacgaccggtaacgggggaccaaacgtcgtaggacgtactaacgaaacgacgtcgtggcgtcacactactctctctttaccg

SEQ ID NO: 331351 - DNA, 572 bp, Homo sapiens
  misc_feature: GZ8MTXP02IG2MT.17.57.F02.1.454.CMB.2.raw
  modified_base (226)..(226): a, c, t, g, unknown or other
  misc_feature (226)..(226): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgctatctgtaggagacagagtcacatctcttggccggnaagtcagagcattagacttaacttttaaatgtatcaggacggaacagggaacacccctaaatcctagatctatactgcatacctaattgacgtaaaggtcgggacctatacgagtcagtgacnggtgntcgngggactagtnttcactctcacctatcgancagtctagacctaactgagtagttttcactaaactttactacgttcgtactaaacgtaggtttaaccgaccgttaaccccgtattaaccggttttcggaaccggtaaacgggacctaggcgttaagggaactacgaaaacccgtaaagtaccgtggtacggtactacgaccaccttatccgtacg

SEQ ID NO: 331352 - DNA, 525 bp, Homo sapiens
  misc_feature: GZ8MTXP02IUJRG.17.57.F02.1.454.CMB.2.raw
  modified_base (222)..(222): a, c, t, g, unknown or other
  misc_feature (222)..(222): n is a, c, g, or t
  modified_base (359)..(359): a, c, t, g, unknown or other
  misc_feature (359)..(359): n is a, c, g, or t
  modified_base (501)..(501): a, c, t, g, unknown or other
  misc_feature (501)..(501): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggnaagtcagagcattagctaaacttttaaatggtaatcagacgggaaccagggaaacgcccctaaaatcctgatctatactgacatccaatttgacaaagtgggtccatcaagttcagtgacagtgatcgtgggacagntttcactctcacatcagcagtctgcaactgagtatttgactaaactttacaacttgtacaaactaggggttaaccacgttaaccccgtatacgtttgggacctaaggggacccaaagctgggaatactacaaaacgacttgnggaactgacacatcctagtcttac

SEQ ID NO: 331353 - DNA, 571 bp, Homo sapiens
  misc_feature: GZ8MTXP02H6VEJ.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatctcttgccgggcaagtcagagcattagactaaactttttaaatggtatcagacgggaaccagggaacgcccctaaactcctgatctatactgctatcctaatttgacgtaaaggtcggggtacccaagtcgtaaagggttcaaggttggactaggtgggtactcgtaggggacagttactttacacctctacaccatcagctagtcagacacgtgagtatttgactaacttactacgtgtacaacgtaggttaccacgtacccgtactacgtttcggaccgaagggtaccaaggtctagggactaacgtaaccgaaaagtaagtggtcggtactacgacctaccgtacttcttccg

SEQ ID NO: 331354 - DNA, 589 bp, Homo sapiens
  misc_feature: GZ8MTXP02GQ6F9.17.57.F02.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (557)..(557): a, c, t, g, unknown or other
  misc_feature (557)..(557): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttggccgggnaagtcagagctattagacttaacttttaatgtatcgaggacggaaccgaggaaaccgacccctaaactcctagacttactatactagactactacctaatttcgacgtaaaggtcggggtaccagtaccgtaaggttccaggtcgctaggtggactcggtaggactagtacttccactctcaactntcgagacntcgtnacctacgtgagttatttcgaccttaatttacacttcgtactaacgtacggttaacctacggttaccccgttatacggtttccggacgacgggtaacacgggcgttagggactaacgtacgaaaccgtagtcggngaaccgtnaccaaccngttccgactttccaac

SEQ ID NO: 331355 - DNA, 487 bp, Homo sapiens
  misc_feature: GZ8MTXP02FJH48.17.57.F02.1.454.CMB.2.raw
  modified_base (448)..(448): a, c, t, g, unknown or other
  misc_feature (448)..(448): n is a, c, g, or t
  modified_base (480)..(480): a, c, t, g, unknown or other
  misc_feature (480)..(480): n is a, c, g, or t
tcagcgtagactagcacgaccggtgctcgatttagctcgatatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaacttttaaatggtatcagcggaaccaggaaagcccctaaatcctgatctatactgcatccaatttgcaaagtggggtccatcaagttcagtgcagtggatctgggacagatttcactctcaccatcagcagtctgcaactgagatttgcaattactactgtacaactagggttacagtacccgtacacttttggcctaggggaccaagcnggtagatacaaacgactgtagctgcaccatcngtcttac

SEQ ID NO: 331356 - DNA, 599 bp, Homo sapiens
  misc_feature: GZ8MTXP02ILCR1.17.57.F02.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (276)..(276): a, c, t, g, unknown or other
  misc_feature (276)..(276): n is a, c, g, or t
  modified_base (555)..(555): a, c, t, g, unknown or other
  misc_feature (555)..(555): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctctgccggnaagtcagagcattagacttaaacttttaatggtatcgagacggaacaagggaaacncccctaaactcctagatactatactgactatacctaatttcgactaaaggtcggggtacccctaagttaccgtaaacggtttccaggttacggacgtaggttaggaacgttccgggttacggggaactaacgttactttacccacttacctaccaacctataccagctaagttctacgacctaacctggtaagtatttgaccttaacttactacttgtacaacgtaggttaccacgttacccgtatacgtttggaccgagggaccaagcgtagacgtanacgaaccgtagtgtacggctcgactactatctacgttcttaccg

SEQ ID NO: 331357 - DNA, 645 bp, Homo sapiens
  misc_feature: GZ8MTXP02G23L3.17.57.F02.1.454.CMB.2.raw
  modified_base (225)..(225): a, c, t, g, unknown or other
  misc_feature (225)..(225): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttggccggganaagtcagagctaattagacttaaactttttaaatggtatcgaggaccgggaaaccaagggaaacgtccccctaaactcctagacttctaatacctgactatacctaatttcgactaaaggtcggggtacccagtacgtaaacggttcaggtcggacgtaggtggatcgtagggactagttacttcgacttctacaccatcagcacgtcacgacctacgtagtagttatttcgacttaacttactacgttacgtacgtaacgtaacgggttacctaaccgttaccccgttacgttaccgttttacgggaccgtaacggggtaacctaacggtcgtaggaacgtaacgtaaacgaaaaccgtaacgtcggtacggtaaccgtacgtaccctaccttacgtccgttacggttacctttacccg

SEQ ID NO: 331358 - DNA, 742 bp, Homo sapiens
  misc_feature: GZ8MTXP02FLMBU.17.57.F02.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggnaagtcagagcattagacttaaactttttaaatggtatcgaggaccggaaaccgaagggaaaccgcccctaaaactccgtagacttctaatactgactactacctaagtttcgacgtaaaacggttcggggtacccctaagtacgtaaacggtttccgaggtcggactaggtacggacttcgggacggggaaactaaggttaccttttaccaacctttcctaacctaacctacttacgacgactacgttccgtacgacccgtaaaccgtgggtaagttacttttcgaaccttaaaccttacttacgtacgtaaccgtaaacggttaacgggttaaccctaacccggtttaacccccgttaacgttaaccggttttaccgggaacccgggtaaacgggggtaacccctaaagggtacgttaacggggaaacgtaaacgttaaacccgaaaaaccggttaccgttcggtacgggaacctacggtaaccctaccgtatttcccgtacgtttccctttaacccg

SEQ ID NO: 331359 - DNA, 548 bp, Homo sapiens
  misc_feature: GZ8MTXP02G2K9H.17.57.F02.1.454.CMB.2.raw
  modified_base (198)..(198): a, c, t, g, unknown or other
  misc_feature (198)..(198): n is a, c, g, or t
  modified_base (275)..(275): a, c, t, g, unknown or other
  misc_feature (275)..(275): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccaccatctcttggccgggacaagtcagagcattagctaacttttaatggtatcagcggaacagggaacnccctaaactctagatctatactgctatacctaatttgactaaaggtcggggtacccagttacgaaggtttcagtcggacaggtcggatcgtgggactagtactttcactctcaccatcagctagtctagacacgtgagttatttcgacttaaccttactacttgtaccaaacgtaggttaccacgttaccccgtatacgtttcggacgagggacctagcgtaggacactacgaaacgacgtcgtaggctagaccactacgtctacgttcttac

SEQ ID NO: 331360 - DNA, 632 bp, Homo sapiens
  misc_feature: GZ8MTXP02GVV0P.17.57.F02.1.454.CMB.2.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
tcagcgtagactagcacgaccggtgctcgatttagctcgatatagttgggtttgggggcaggagtcagtctcagtcaggacacagcatggacatgagggtccccgctcagcgtcctggggctcctgctactctggctccgaggtgccagatgtgacatccagatgacccagtcctccatcctccctgtctgcatctagtaggagacagatcacntctntgccggnaagtcagagcatagactaacttttaaagtgtatcgaggaccggaacgagggaaaccgacccctaaactcctagatctaactactgactactacctaatttgacgtaaaggtcggggtaccagtacgaacgttcaggtggacaggtgntcggtagggactagtactttacgactctacaccntacagtcacgtctgacctacgtagagttatttacgaccttaactttacgtacttacggtaacctaaacggttaacggttacctaaccgttaaccccggttaacttacggttttcggaacccggtaaacggggtaccgaaacggtcggttacgggaacgtaacgtaaaccgtaaacggtaaacgttcggtacggaccgttacggaacctaccgtagtttctttaccg

SEQ ID NO: 331361 - DNA, 543 bp, Homo sapiens
  misc_feature: GZ8MTXP02HQGQS.17.57.F02.1.454.CMB.2.raw
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatctcttggccgggcaagtcagagcattagacttaaactttttaaattggtaatcgaggaccgggaaaccaggggaaacacccctaaactcctagatctatactgactactacctaatttgactaaaggtcggggtacccatacgaaggttcagtgcgagtcggatcgtagggacagtactttcactctacaccatcagcagtctcgactaactgagtatttagactaacttactactgtacaacgtaggtacacgtaccctactacgtttcgacgtaggaccaagcgtaggacgtactacgaacgactagtgctcgacactatctctcttac

SEQ ID NO: 331362 - DNA, 558 bp, Homo sapiens
  misc_feature: GZ8MTXP02JLAXN.17.57.F02.1.454.CMB.2.raw
  modified_base (225)..(225): a, c, t, g, unknown or other
  misc_feature (225)..(225): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcacatctctggccgggnaagtcagagctattagactaaacttttaaatggtatacgaggaccgggaaaccgaagggaaacgacccctaaactcctagactctaatactgactatacctaatttgaactaaaggtcgggtaccctagtactaaggttcaggtggacgagtggactcggtaggaactagtactttacgactcgtacacgtataccgagtcagtcgtacgacctaacgtgtagttatttacgactaaactatactgtaaccaagtaggtacctcgtaacctctacgttcgacgtacggacagctagagtacacgaaagtactgacgctacgactacatctacg

SEQ ID NO: 331363 - DNA, 701 bp, Homo sapiens
  misc_feature: GZ8MTXP02JNP6A.17.57.F02.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcacatctctcggccggnaacgtcagngactattagtacttaattttaaagtgtatcgaggaccggaaccgaaggaaaccgacccctaaacgtcctagtacttctaatactgactacgttacctaatttacggaacgtaaacggtccgggttacccagttacgtaacggttacaggttacggacgtaggtgggtaccttacggtaggggtaactacggttaactttccaccttacccttaccgaaccccttaacgtaccgtacgtacccgtacgttacccgtacgtaaccgttaacggtacgttaacgtttacgtttaccgtaaaccttaaccgtttaacgtaccgttacgtaaacgtaaccggttacggttaacccgtacccggttacccgttacgtttaccggtaccggaacccggtaacggtactacggtacgtaacggaactaacgtaaccgtaacgtgtcgtacgtcctacgacctacttacttcgtacg

SEQ ID NO: 331364 - DNA, 533 bp, Homo sapiens
  misc_feature: GZ8MTXP02I6ZBJ.17.57.F02.1.454.CMB.2.raw
  modified_base (393)..(393): a, c, t, g, unknown or other
  misc_feature (393)..(393): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagactaacttttaaatggtatcaggacgggaaccagggaaacgccccctaaactcctgatctatactgactactcctaatttggacaaaggttcggggtccccaatcgaaaggttcaggtgcagtggatcgagggacagtatttcactctccaaccntaccagctagtctgacctaaacgtgtaggtatttgacctacttacgtactgtacaacggtaggttacagtaccccgtatactttggaccgaggggacaacgcgtgacanacaaacgatgagntgcacgtatctcgtactc

SEQ ID NO: 331365 - DNA, 612 bp, Homo sapiens
  misc_feature: GZ8MTXP02JEFXE.17.57.F02.1.454.CMB.2.raw
  modified_base (279)..(279): a, c, t, g, unknown or other
  misc_feature (279)..(279): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagactaaactttttaatggtatcaggacggaaccaggggaaacncccctaaactcctgactctatacctgcatcctaaatttcgactaaacggttcggggtacccctaagttaccgaaaggttcaggtggactaggtggatcggtagggactagtatttcacttctaccaccattcagctagttcctagacctaaaccgtggaagttattttcgacctaaactttacgtactagtactaaacggtaacgggttaaccaaccggtttaacccccgtagttacgtttcggaccgtaacggggaaccaacggtccgtagggactaacgtaacgaaaaccgtactgtacggaacctgaacctcctatcgttcttacttacc

SEQ ID NO: 331366 - DNA, 551 bp, Homo sapiens
  misc_feature: GZ8MTXP02FMIUK.17.57.F02.1.454.CMB.2.raw
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccggnaagtcagagctattagacttaaacttttaaatggtatcgaggacggaaaccagggaaacncccctaaatcctagatctatactgacatcctaagtttcgacgtaaaggtcggggtaccagtacgtaaggtnaggtggcaggtgatcgaggacagtactttcactctcaccatcagcagtctcgacacgtagaggttatttcgacttaacttactactagtaacgaacgtaggttaccacgttacccgtagtacgtttcggaccgtacgggacagcgaggacacgtaacaacgtaagtgtacgactacgacctacgtactctttacg

SEQ ID NO: 331367 - DNA, 571 bp, Homo sapiens
  misc_feature: GZ8MTXP02HHJE5.17.57.F02.1.454.CMB.2.raw
  modified_base (180)..(180): a, c, t, g, unknown or other
  misc_feature (180)..(180): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
  modified_base (552)..(552): a, c, t, g, unknown or other
  misc_feature (552)..(552): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaaacatagccttctccgtccccccttgcagtaacaccaagtacaggaatattaacctgttccatcgactacgccttcggcctcgccttagggtcactcaccctgccccgatacgtggacagacctgtctcgnagcggctttcaccgtnttatcgtaccttatgtcagcattcgctacttctagactaccctcagtccatcgcctcacacgacacaccttcacacgactacacgaacgacctaccctaacccaacaaccgacaacaacgacgtcgctcgccgacacgtcgtcggttcggactacgtacgttacgtcccgttcctactccgttcccnccactactcactacgtccg

SEQ ID NO: 331368 - DNA, 609 bp, Homo sapiens
  misc_feature: GZ8MTXP02JCV5L.17.57.F02.1.454.CMB.2.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (412)..(412): a, c, t, g, unknown or other
  misc_feature (412)..(412): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatcgtgtagganacagagtccaccattctcttggcccgganaagtcagagcattagacttaacttttaatggtatcgagacggaaccagggaaacgacccctaaactcctagactctatactgacactacctaatttcgactaaacggtcggggtcccaagtcaaacggttcagtcgcgtagtggatcgtgggacagtacttcgaactctacaaccgtactcgancgtactcgtagacctaacgtgacggttatttcgaacttaaaccttacttacgtgttaaccaacgggttaacggtaactaccggttaaccccgttacgtacgtttacgaccggtaaggtacccgagtacgtaggaacgtaactaacgaaacgtaacgtgtcggaacgtcgaccgtacctagtctacgttccttaaccg

SEQ ID NO: 331369 - DNA, 634 bp, Homo sapiens
  misc_feature: GZ8MTXP02IUKBJ.17.57.F02.1.454.CMB.2.raw
  modified_base (226)..(226): a, c, t, g, unknown or other
  misc_feature (226)..(226): n is a, c, g, or t
  modified_base (282)..(282): a, c, t, g, unknown or other
  misc_feature (282)..(282): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgaccccagtctccatcctccctgtctgcatctgtaggagacagagtcacatctcttggccggnaagtcagagcaattagactaaactttttaaatggtatcagacggaaacaggaaacncccctaaactctagatctatactgctatcctaatttgacgtaaaggtcgggtacccatcaaggttcaggttggacagtgggattcgtggggactagtactttcacttctacaccatacagctagtctacgacctaacgtggtaaggttattttacgactaaacctttacgtaccttacgtaaccaaacgttacgggtttaaaccacggttaacccccgttaacgttacgtttacgggaccggtaaacggggaacctaaaggtccgtaaagggtaaacgtaacttaaccggaaaaacgttacgttaacggtacgggaccttaacggacctaacccgtagtttacccgtttacg

SEQ ID NO: 331370 - DNA, 590 bp, Homo sapiens
  misc_feature: GZ8MTXP02H4PBG.17.57.F02.1.454.CMB.2.raw
  modified_base (226)..(226): a, c, t, g, unknown or other
  misc_feature (226)..(226): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatctcttgccgggnaagtcagagcattagactaaactttttaaatggtatcaggacgggaaccaagggaaacgcccctaaactcctgatactatactgcatacctaatttgactaaaggtcggggtacccagtacaaggttcaggtggcaggtcggattcgtaggggactagtactttcactctcaccatacagcagtctacgactaaccgtagagttattttgacttaaactttactactagtacaaacgtacgggttacaccggttaaccccgtattaccgtttcggaccgtaacggggacctaaaggtctaggggaactacaaccgtaaaacgaacgttcggtacggtcctaggcccctaacctagtacctttcg

SEQ ID NO: 331371 - DNA, 619 bp, Homo sapiens
  misc_feature: GZ8MTXP02HBPK6.17.57.F02.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttggccgggnaagtcagagacattagctaactttttaaatggtatcaggacggaaccagggaaacgcccctaaatccgtagatctatactgacatacctaatttcgactaaaggtcggggtaccacgtacgtaaggttcaaggttggacaggtcgggattcgtaggggacagtactttcaacttcctacacccatcagactatcctgacaacgtgaggttactttgacctaactttacgtacttacgtaactaacgtacgggttacctaccggttacccgtaaccttacgttttacggacccgttaacgggggaacccaaggtacccgttaggggaaacgtacgttaaacctaaacggtaaaccgtggtacggtactacggactaccgttactccgtttacg

SEQ ID NO: 331372 - DNA, 573 bp, Homo sapiens
  misc_feature: GZ8MTXP02FQST5.17.57.F02.1.454.CMB.2.raw
  modified_base (302)..(302): a, c, t, g, unknown or other
  misc_feature (302)..(302): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagacgtcaccatctcttggccgggacaagtcagagactattagacttaaacttttaatggtatcgagaccggaacaggaacaccctaaactctgactntatactgactactacctaatttcgaaccgtaaaggtccggggtacctagtaccgtaggtacgaaggttggacgtagggtgactacggtaggacctagtactttcactcncactancagcagctacgacctaactagtagttactttacgacttaaacttacgtacctagtacaacgtaggtaccacgttacccgtatacgttcggacgacgggtaccaaggcgtaaggacacgtacgaaacgtacgtgcgactcgaccactacgttctacg

SEQ ID NO: 331373 - DNA, 559 bp, Homo sapiens
  misc_feature: GZ8MTXP02HQ6L0.17.57.F02.1.454.CMB.2.raw
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatctcttgccgggcaagtcagagcattagactaaactttttaatggtatcgaggacgggaaccagggaaacgacccctaaatcctagatctatactgacataccaatttgactaaaaggtcggggtacccagtacgtaaggttcaggtggcaggtggatcgtgggacagtatttcacttctccacagtcagacagtctcgactaactggaggttatttacgactaacttactactacgtactaacgtaggttaacaccgttacccgtactacgtttcggacgtacgggaccagtcgtaggaacaacgtaacgaaacgacgtagtgcgtacgactaccatctcttcttac

SEQ ID NO: 331374 - DNA, 698 bp, Homo sapiens
  misc_feature: GZ8MTXP02JWHG5.17.57.F02.1.454.CMB.2.raw
  modified_base (199)..(199): a, c, t, g, unknown or other
  misc_feature (199)..(199): n is a, c, g, or t
tcagcgtagactagcacgaccggtgctcgatttagctcgatatagttgggtttggggggagtcagtctcagtcaggacacagcatggacatgagggtcccccgctcagctcctggggctcctgctactctggctccgaggtgccagatgtgacatccagatgacccagtctccatcctccctgtctgcatctgtagganacagagtccaccatctcttggccgggacaagtcagagctaattagacttaaactttttaaatggtatcgaggacggaaacagggaaacacccctaaactcctagatctaatactgctaactcctaaattttcgactaaaacgggttcggggtacccctaagttaccgaaagggtttccgaaggttcgggactaagggtaggaattcggtaggggaactaagttatttaccacttccacaaccctagacaacgcacggttcctaggaccctaacgttaggtaaggttacttttacgaaccttaaactttaacctattacggtaactaacggtaagggttaacccaaccggtttaaccccgtaacgttaaccgtttcgggaccgttaaacgggggacccttaaaagaccggttagggaaacttaaacgaacgaaaaaccgtacgttaggggtacgaaccggttacgacctaaacccgtagttcccgttagttactttaccc

SEQ ID NO: 331375 - DNA, 703 bp, Homo sapiens
  misc_feature: GZ8MTXP02HZAMO.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctggtaggagacagactcaccatctcttggccggacaagtcagagctaattagacttaaactttttaaagtggtatacgaggacgggaaaccgaagggaaaccacccctaaactcctagactactaatactgacatacctaagttgaacgtaaaggtcggtaccagtacgtaaggttcaggtgcgaggtgatcgaggaactagttctacacctctacaactatcacgtactagtcctacgtaccctaaacgtgtaaacggtttattttacgaaactttaaacctttagtaaaccgttacggtaaaccgtaaacgggtaaacggggtttaaccctaacccgggttaaacccccttaacgtttaacggtttacccggggaacccggtaaaccgggggaaaccctaaagggtaccgttaacgggggaaacttaaaaccggtaaccgttaaaaaccggaacggtttcgggtaccggacctttacggaaccgtaaccctacgtttctttacccgg

SEQ ID NO: 331376 - DNA, 608 bp, Homo sapiens
  misc_feature: GZ8MTXP02I9427.17.57.F02.1.454.CMB.2.raw
  modified_base (228)..(228): a, c, t, g, unknown or other
  misc_feature (228)..(228): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
tcagcgtagactagcacgaccggtgctcgatttagctcgatatagttgggtttgggggcaggagtcagtctcagtcaggacacagcatggacatgagggtccccgctcagctccgtggggctcctgctactctggctccggaggtgccagatgtgacatccagatcgacccagtcctccatcctccctgtctgcatctgtaggagacagagtcacatctctggccggnaagcagagcattagacttaaactttttaaagtggtatcgaggaccgggaaaccgaagggaaaccgaccccctaaactcctagtatcctaatactgactataccaagtttgacgtaaaggtcgggtaccaagtcgaagttcagttcggnagtgactgtggactagtcttcactccncaacactcgacactagtctacgacctaaccgtagtacgttatttacgtaactaacgttacctacgttgtaaccgaacggttaacgggttaacctaccggtaacccgttacgttacgtttcgaccggtaacgggaccgaagcgtacggaactaacgtaacgaaaaccgtaagtcggtacgtcgtacgactacctactcgtttaccg

SEQ ID NO: 331377 - DNA, 546 bp, Homo sapiens
  misc_feature: GZ8MTXP02IRIUA.17.57.F02.1.454.CMB.2.raw
  modified_base (274)..(274): a, c, t, g, unknown or other
  misc_feature (274)..(274): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaacttttaaatgtatcagcggaaccagggaaacncccctaaactcctgatctatactgcatccaatttgactaaaggtgggtccatcaaggttcagtgcaggtgatcgtgggacagtatttcactctcaccatcagctagtctagcctaacgtgagtatttgactaactttactacttcgtacaacgtagggttaaccacgttaaccccgttactaacgttttcggaccgtaacggggaccctaagcgtaggacgtaactacgaaacgactggtacggcgtcgactaccgtatcttcgtactttcc

SEQ ID NO: 331378 - DNA, 526 bp, Homo sapiens
  misc_feature: GZ8MTXP02IWUXS.17.57.F02.1.454.CMB.2.raw
  modified_base (281)..(281): a, c, t, g, unknown or other
  misc_feature (281)..(281): n is a, c, g, or t
  modified_base (381)..(382): a, c, t, g, unknown or other
  misc_feature (381)..(382): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagactgagtcaccatctcttgccgggcaagtcagagcattagctaattttaatgtatcagcggaacaggaacacccctaaactctnatctatactgctatcctaatttgacgtaaaggtcggggtcccagtactaaggttcagtggcagtggatcgtagggactagtatttcactctcaccatcannagtctgccactgagtatttcgactaactttacacttgtacaacgtacggttacaccgttacccgtactacgtttcggaccgagggaccaagcgtaggacgtacaacgaaacgtactgtacgctcgactactatcgtcttcttac

SEQ ID NO: 331379 - DNA, 574 bp, Homo sapiens
  misc_feature: GZ8MTXP02I77CE.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctgccggnaagtcagagcattagactaacttttaaatggtatcaggaccggaaaccagggaaacacccctaaactcctagatctatactgacatacctaatttcggacgtaaaggtcggggtacccaagttacgtaaaggtttcaaggttggacgtaggtggtactcggtaggggactagtactttcacttacacacctatcagtcagtcagactaactgaggttatttgactaacttactactgtaaccaagtacggtacacgttacccgattacgttacggaccgtaagggaccaaaggtcgtaaggacgtactaaaccgaacgtactggtcggactcgactaccgtatcgtttcg

SEQ ID NO: 331380 - DNA, 580 bp, Homo sapiens
  misc_feature: GZ8MTXP02JUL3O.17.57.F02.1.454.CMB.2.raw
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagactaacttttaatggtatcaggcggaaccgagggaaacacccctaaactcctagatctatactgcatcctaatttgactaaaggtcgggtaccatacgtaaggttcaggtgctaggtggatcgtagggactagtacttcactctacacctatcacgtcacgtctgacctaacgtgaaggttatttcgaacttaacctttactacgtcgtacaacgtaagtacttaacctaactccccgtcggtaccttacctacggtttcgggacggggtacggaaccgtaaaggggtagaacgacgtaacgaaaacgtacgtggtacgcctacgacctacctcgtcttacg

SEQ ID NO: 331381 - DNA, 515 bp, Homo sapiens
  misc_feature: GZ8MTXP02HVKG0.17.57.F02.1.454.CMB.2.raw
  modified_base (286)..(286): a, c, t, g, unknown or other
  misc_feature (286)..(286): n is a, c, g, or t
  modified_base (376)..(376): a, c, t, g, unknown or other
  misc_feature (376)..(376): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
  modified_base (502)..(502): a, c, t, g, unknown or other
  misc_feature (502)..(502): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcaccatctcttgccgggcaagtcagagcaattagctaaactttttaaatggtatcaggacgggaaaccaagggaaacncccctaaactcctgatctatactgacatcctaatttgactaaaggtcggtaccagtcaagttcaggtggctagtggatcgtgggacagtntttacactctcacctatcagcagtctgacactgacgtntttgactacttacntgacaagaggtacacgtcctatacgttcggacagggaccagctagacacgtacaaaacgtctaagtgactacgnacctagttctacg

SEQ ID NO: 331382 - DNA, 541 bp, Homo sapiens
  misc_feature: GZ8MTXP02FM21Q.17.57.F02.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (391)..(391): a, c, t, g, unknown or other
  misc_feature (391)..(391): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatctctggccgggnaagtcagagcattagacttaaacttttaaatggtatcgaggaccggaaaccaagggaaacgcccctaaactcctagatctatactgcatccaatttgactaaaggtcgggtccatacgaaggtcaggtgacaggtgatcgtaggggacagtacttcactctccacntcagcagtctgaccaacgtagacggttatttcgactaacttactacttagtacaaacgtgttacacgtacccgtatacgttcgacgacgggtacagtcgaggacgactaacgaacgtaacgtggtacggcgtacactacacttcgttacg

SEQ ID NO: 331383 - DNA, 559 bp, Homo sapiens
  misc_feature: GZ8MTXP02FYXNN.17.57.F02.1.454.CMB.2.raw
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaaattggtatcagcggaaccagggaaagcccctaaaactcctagatctatactgcatccaaatttgctaaagtggggtccatcaaggttcagtgcagtggatcgtgggacagatttcactctcaccatcagcagtctgcaactgagtatttgactaacttactactgtactaaacgtagggttaaccacgtaacccgtactacgtttcggaccgtagggggaccaaaggtctagggagaacttacgaaaacgtaaacgtggttacgggaaccttacggacctaaccctaagttacctacggtttctttaccc

SEQ ID NO: 331384 - DNA, 609 bp, Homo sapiens
  misc_feature: GZ8MTXP02ILADP.17.57.F02.1.454.CMB.2.raw
  modified_base (287)..(287): a, c, t, g, unknown or other
  misc_feature (287)..(287): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctctggccggcaagtcagagctaattagacttaaacttttaaattggtaatcgaggaccggaaaccaagggaaacnccccctaaactcctagatactatactgactactcctaatttgactaaaggtcggggtacccatcgtaacggttcagtggacaggtggatcggtagggactagtacttcactctacaccatcagcagtctcgacctaactggtaaggttactttgaaccttaacttaactacgttacgtactaaacgtacgggttaaccaccgttaccccgttaattacgtttacggaccgaaggggaacctaaggtcgtaggaacgtaactaaccgaaaacgtacgtggaacggtctcgacccgtacctacttaccgttacgttacctaccg

SEQ ID NO: 331385 - DNA, 603 bp, Homo sapiens
  misc_feature: GZ8MTXP02GQMDB.17.57.F02.1.454.CMB.2.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatctctgccggnaagtcagagcattagctaacttttaaatggtatcgagacgggaaccagggaaacgcccctaaactcctagatctatactgcatccaatttgacgtaaaggtcggggtacccaagtacgtaacggttcaaggttcggctaggtgggattcggtaggggaacctaggttactttcaacttccactaaccctattacgctaagttctacgtaccaaaccgtagtaggtattttacgacttaaacttacttaacgtcgttaaccgaacgtaaacgggttacctaaaccgttaccccgtaacttacggtttacgggacgacggggtaacaaggtctacggtaagactacgaaacgaagttgaagctcgacacctatcgtacttac

SEQ ID NO: 331386 - DNA, 761 bp, Homo sapiens
  misc_feature: GZ8MTXP02JLE21.17.57.F02.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
tcagcgtagactagcacgaccggtgctcgatttagctcgatatagttggggtttggggggagtcagtctcagtcaggacacagcatggacatgagggtcccccgctcagctcctggggctcctgctactctggctccgaggtgccagatgtgacatccagatcgacccagtcctccatccctccctgtctgcatctgtagganacagatccacatctcgttggccggacaagtcagagctattagacttaaacttttaagtggtatcgacggacggaaaccgaaggaaaccncccctaaactcctagattctanactgctactactaatttgaacgtaaaggttcgggtaccctaagtacgtaacggttcgagggtcggacgtaggtaggactcggggtagggtaaacctaggtttaaactttcccaaccttccttacccaaaccgtacttacgaaacggttctaacgttaccgtacggtaaccccgtaaacgttacgggttaagttacgtttttaaccgaaacccttaaaccttttaaccggttaacttaccgttaaaccgtaaaccgggtttaaaccggttacccgttaaacccccgggttaccccgtttaaaccgttaccggtttaaccgggaacccgggttaaaccggggaaacctacgggttacgaaaggggtaaacctaaactaaacccggtaaaacgtccggtaggtaccgtaacgtaccgacctaacgttacttccgtaacttctttaacccg

SEQ ID NO: 331387 - DNA, 644 bp, Homo sapiens
  misc_feature: GZ8MTXP02JYSJ2.17.57.F02.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagcgtagactagcacgaccggtgctcgatttagctcgatatagttgggtttggggggagtcagtctcagtcaggacacagcatggacatggacggggtccccgctcagctccgtggggctcctgctactctggctccgaggtgccagatgtgacatccagatgacccagtctccatccctcctgtctgcatctgtagganacagagtcaccatctctcggccgggnaaggtcagagctaattacgtacttaaactttttaagtggtatacgaggaccgggaaacgaacgggaaaccacccctaaactcgtagtatctatactgactactacctaagtttgacgtaaaggtcgggtaccctagtacgtaacggttcaggtcgctaggtggatcggtagggaactagtacttccactcctcaacctatccagtctacgtctcgaccctaacgtgtaaggttatttacggacttaacctttactacgttagaacctaacggtacgggttaaccacccggttaaccccgttattacgtttacggaccggtaaggggaaccctaggtaccgtaggaactacgtaaccgtaaaacggtacgtgggtaccggaactcggtacccacttacggtcttacgtcctttaccg

SEQ ID NO: 331388 - DNA, 597 bp, Homo sapiens
  misc_feature: GZ8MTXP02JCVUL.17.57.F02.1.454.CMB.2.raw
  modified_base (201)..(201): a, c, t, g, unknown or other
  misc_feature (201)..(201): n is a, c, g, or t
  modified_base (418)..(418): a, c, t, g, unknown or other
  misc_feature (418)..(418): n is a, c, g, or t
  modified_base (569)..(569): a, c, t, g, unknown or other
  misc_feature (569)..(569): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
tcagcgtagactagcacgaccggtgctcgatttagctcgatatagttggggtttggggggagtcagtctcagtcaggacacagcatggacatgagggtccccgctcagctcctggggctcctgctactctggctccgaggtgccagatgtgacatccagatgacccagtcctccatcctccctgtctgcatctggtagganacagagtccaccatctcgttgccgggacaaggtcagagctaattagacttaaactttttaaatggtatacaggacgggaaaccaaggggaaaccacccctaaactcctagacttactatactgctactacctaaatttcgacgtaaaggtcggggtacccagtacgtaaacggttcaaggtgacgtaggtggatcggtagggactagtattcactcncgaccatcagcagtctagacctaaacgttggtaacgttatttcgaaacttaccttaatacttacgtaactaaggtaacggttaccgtacgttaccccgtattacgttcggaaccgtagggaacagtacgtgaacgtacaacgaacgtacgngtcggctagacctacgntcttanacttc

SEQ ID NO: 331389 - DNA, 643 bp, Homo sapiens
  misc_feature: GZ8MTXP02HGZWV.17.57.F02.1.454.CMB.2.raw
  modified_base (549)..(549): a, c, t, g, unknown or other
  misc_feature (549)..(549): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacacaagtacaggaatattaacctgttcccatcgactacgccttcggcctcgccttagggtcactccaccctgccccgattaacgttggacaggaacccttggtcttccggcgagcgggtctttccaccgtctttatcgttaccttatgtcagcattcgctacttctgactaccctcagcatcgccctcacagccacctaccttcaacgtacggcttaacaacgaaccgccctaccccctaacccaaaccaaccgacaacgtaaacgccgtccgactcggcccgtacacggtcttccgggnggtcctaaaggttccgggtttaaccgtcccccgttttacaccctttcccgttcccccgaccgtaacttccgtacggtaccctttacgttacccg

SEQ ID NO: 331390 - DNA, 620 bp, Homo sapiens
  misc_feature: GZ8MTXP02JGK38.17.57.F02.1.454.CMB.2.raw
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctctgccggcaagtcagagcatagactaacttttaatgtatcagcggaacaggaacaccctaaactcngatctanactgcatacctaatttgacgtaaaggtcggggtacctagtacgtaaggttcaggttcggacgtaggtcggtattacggagggggtaacaggttactttccaccttacctacctaacctatccagaccgtagtcctagacccgtaacgtaggtaggttaactttcgaacttaaactttacctacgttacgtaaacctaacggtaaacgggttacctaaccggttaaccccgtacgttacgtttacgggaaccgtacggggaacctaacggtcgtacggaacgtacgtaaacgaaacgtacgtcgtacggctacggacctacctacgtctttcg

SEQ ID NO: 331391 - DNA, 736 bp, Homo sapiens
  misc_feature: GZ8MTXP02FNDWO.17.57.F02.1.454.CMB.2.raw
  modified_base (230)..(230): a, c, t, g, unknown or other
  misc_feature (230)..(230): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccactccctccctgtctgcatctgtaggagacagagtcaccatctctggccggganaagtcagagctattagacttaaacttttaaatggtatcgaggacggaaaccgagggaaaccacccctaaactcctagatctatactgcactacctaatttgaacgaaaggtcgggtcccaagtaccgtaaggttcaagtggacgtaggtggactcggtagggaactagttactttaccacttacctaccaacctataccgaagtaccgtacgttaccgtacggaccctaaacccgtaggttaagggtttaactttttaaccggaaaccctttaaaacccgtttaaccttaaaccgtttacggttaaaccgtaaaaccggttaaccggggtttaaaccgtaaacccggtttaacccccgttaaccgttaaccggtttttacggggaacccggtaacgggggtaaacccgaaacgggttaccggtaagggtaaacggtaaacgtaaaccggtaaaccgtaaccggtaaggtacggtaccgtacgtaccgaaccgtacttccgtttacg

SEQ ID NO: 331392 - DNA, 591 bp, Homo sapiens
  misc_feature: GZ8MTXP02IX2M7.17.57.F02.1.454.CMB.2.raw
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
  modified_base (411)..(411): a, c, t, g, unknown or other
  misc_feature (411)..(411): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctcctgtcttcatctgtaggagacagagtcaccatctcttgccggnaagtcagagcattagacttaaactttttaatggtatcgaggaccggaaaccgaagggaaaccncccctaaactcctagactctatactgactactacctaatttcgactaaaggtcggtaccagtaccgaaggttcaggtgcaggttggatcgagggactagtacttcactctaccacatacgancgtatctacgactaacgtggtacgttatttcgaaccttaaaccgtttactacgtacaccgtaaactagtacttacattactaatacttagtttagtttacggttagggtaggaacggaacgtaaggggttcggaaacgtaccgtaaaagaacgttggacggtctagaccaactcgtttcg

SEQ ID NO: 331393 - DNA, 606 bp, Homo sapiens
  misc_feature: GZ8MTXP02HV989.17.57.F02.1.454.CMB.2.raw
  modified_base (201)..(201): a, c, t, g, unknown or other
  misc_feature (201)..(201): n is a, c, g, or t
  modified_base (429)..(429): a, c, t, g, unknown or other
  misc_feature (429)..(429): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccggaggtgccagatgtgacatccagatgacccagtctccatcctcctgtctgcatctgtagganacagagtcaccatcctcgtgccgggacaaagtcaagagctaagttagactaaaactttttaaatggtaatcaggacggaaaccaaggggaaaccacccctaaaactcctagactactaatacctgacctaatacctaaatttgaaactaaaggtcggggtacccaataccgaaagggtttcaaggtggacagtggaattgagggacagtatttcaactctcaaacganacacgcactactacgacaacgtagtagtagttagtactaacttaactactacgtacgtaaacgtaacggtaacgtaaccgtaacccgttaaccgttaccgttacgtaaccggaacggacgaacgacgtacgacgaacaacgaaacgaacgtaagtacgacgtacacactactactcg

SEQ ID NO: 331394 - DNA, 632 bp, Homo sapiens
  misc_feature: GZ8MTXP02GPV59.17.57.F02.1.454.CMB.2.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
  modified_base (422)..(422): a, c, t, g, unknown or other
  misc_feature (422)..(422): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacctntcttctggccggnaagtcagngctattagactaaactttttttaaanggtatcgaaggacgggaaaccgaaggggaaacgacccctaaactcctagatctaatactgactacttaccaagtttgacgtaaaggtcggggtaccctagtaccgtaaggttcagtggacagtcgggatcggtagggactagttacttcactctacactancagctatctgactaacgtagaggttaatttcgactaactttactacttacggtaccaaacgtacggttaacctaaccgttaccccgttaacgttaccgttttacggacccggttaacggggaaacccgtaaggtaccgtaggaaacgacgttaaacgaaaacccgtaagtaacggttacggaccttacgacccgtaactacttactttcg

SEQ ID NO: 331395 - DNA, 681 bp, Homo sapiens
  misc_feature: GZ8MTXP02J0CP7.17.57.F02.1.454.CMB.2.raw
  modified_base (333)..(333): a, c, t, g, unknown or other
  misc_feature (333)..(333): n is a, c, g, or t
tcagcgtagactagcacgaccggtgctcgatttagctcgatatagttgggtttggggggagtcagtctcagtcaggacacagcatggacatgagggtcccccgctcagctccgtggggctcctgctactctggctccgaggtgccagatgtgacatccagatcgacccagtcctccatccctccctgtctgcatctgtaggagacagagtaccaccattcctcgttggccgggacaagtcagagtactattacgtacttaaactttttaagtggtatcgacggaccgggaaaccgaacgggaaaccacccctaaactctagtactactatacngtactactacctagttcggaactaaaggtcggtaccagtacgtaacgttcgaggtggacgtaggtggatcggagggtacagttacttcacttctacccaacctatacgacgtctaacggtctcgtaacctaacgtgtaaccgggtttatttaccgaacctttaaacttacgtacgttacgtaaacctaacgggttaacggttaacctaacccggttaaccccgttacgtttaaccggttccggggaaccggtaaacggggtaaaccgtacggtacgggtaagaacgtaacgtaaaccggtaaacgtaccgtggtaccgcgtacaccctacgtctcgttactactaccg

SEQ ID NO: 331396 - DNA, 654 bp, Homo sapiens
  misc_feature: GZ8MTXP02GK23I.17.57.F02.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccggganaagtcagagctattagacttaaattttaaatggtatcaggacggaaccaagggaaacacccctaaactcctagatctatactgactactacctaaatttgaacgtaaaggtcggggtacccatacgtaacggttcgagtggacaggtggtatcggtagggaactagtactttacacttctacaccatcagctagtctacgaccgtaactaggtaggttatttacgaaccttaaacctttaacttacgttagtaccgtaaaacggtacggttaaacccgtaacccggttaaccccggttaacttaacgggtttaccggacccgggtaaacgggggtacctaaaacggtcggttaaggaacgtaaacgtaaccgaaaacgtaccgttaggtacggcgtacgacctaccgtacttccgttacgttcctttacg

SEQ ID NO: 331397 - DNA, 610 bp, Homo sapiens
  misc_feature: GZ8MTXP02FZ744.17.57.F02.1.454.CMB.2.raw
  modified_base (381)..(381): a, c, t, g, unknown or other
  misc_feature (381)..(381): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (496)..(496): a, c, t, g, unknown or other
  misc_feature (496)..(496): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatacgccttctccgtcccccttcgcagtaacaccaagtacagaatattacctgttccatcgactacgccttcgcctcgcttagggcactcaccctgccccgattaacgttggacacggtaacccttggtccttccggcgagtcgggtcttttcgacccgtntttatcgttactactgtcagctattcgctcttcngatacccncaagcatcgcctcacgacnccaacctacctcacacgtactaacacgaccaccctaccccaacccaacaaccanaactacgcgtcgctcgccgcgtacgtcgttcggcgtacgtacgtttcggtttaccgtccccgtttactaccgttcccgtcccgactacttccgtacgtacgttacgtacctacg

SEQ ID NO: 331398 - DNA, 613 bp, Homo sapiens
  misc_feature: GZ8MTXP02GE28I.17.57.F02.1.454.CMB.2.raw
  modified_base (227)..(227): a, c, t, g, unknown or other
  misc_feature (227)..(227): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtctccatccctccctgtctgcatctgtaggagacagagtcacatctctgcccgggnaagtcagagctattagactaaacttttaaattggtatacaggacggaaaccgaagggaaacgcccctaaactcctagactactatactgactactaccaatttgactaaaggtcggggtaccacgtacgaacggttcaggtggacgtaggtggtaacgtcgtaggggaactacgtattttccactttaccaccaaaccctatacacggtctactcgttacgacaaccgtggaaggttattttcgacctaaactttacgtacgtgtaaccaaacggtacggttaaccacgttaaccccgtctaacgtttcggaccgacggggacctaaagcgtagggaaactactaaacgaaaccgaatggtacggctacgacctacacctttagtc

SEQ ID NO: 331399 - DNA, 552 bp, Homo sapiens
  misc_feature: GZ8MTXP02F66SE.17.57.F02.1.454.CMB.2.raw
  modified_base (223)..(223): a, c, t, g, unknown or other
  misc_feature (223)..(223): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctctgccggnaagtcagagcattagactaacttttaaatggatcagcggaacaggaacgcccctaaatccagatctatactgacatcctaatttgacaaaggtcgggtacccaagtaccgtaaggttcaggttggactaggtggatcggtagggacagttactttcactctacaaccatacagcagtctgacaacctagagtatttgactaacttactactagtacaaacgtacgggtactaacgtaacccgtactaaccgtttcggaccgtaacgggaccgaaagtcgtaggaagaactaacgaaaccgaactgtagacgtcgacctactactcttcg

SEQ ID NO: 331400 - DNA, 545 bp, Homo sapiens
  misc_feature: GZ8MTXP02GBTRL.17.57.F02.1.454.CMB.2.raw
  modified_base (390)..(390): a, c, t, g, unknown or other
  misc_feature (390)..(390): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagctaaacttttaatggtatcgagcgggaaaccagggaaacgcccctaaactcctagatctatactgcatccaatttgacaaagtcggggaccatcaaggttcagtggcaggtggatcgtgggacagtatttcacttcaccacctatcagcagtntagcaaacctgagtatttgaactaacttactactgtacaacgtagggttaaccacgtaccccgtattacgtttcggaccgaggggtaccaaagtcgtaggaacgaataccgaaaacgtactggtcggaactcgaccaccattctcgttccttacg

SEQ ID NO: 331401 - DNA, 821 bp, Homo sapiens
  misc_feature: GZ8MTXP02GLIG9.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagagtcaccatctcttggccggacaagtcagagcattagcagtacttaatttaaagtggtactacgagacgaaacgaaaccgaagggaaaccgtccccctaaagtccttaccgtagtactttcctttagccttcgtacctacttaccgtaaggtttcgaacccggttaaacggttccggggttaccccttagtaacggtttccaagggtcgggacgtaagggttcggtaacgttcccgggtaggggtaaactaacggtttacgtttacccgtaaccttcccgttaaccgaaccctaacgttacccgaaccggtacctaacggttacccgtaccgaacccgttaaacccgttaaggttaaaaccggtttactttttaaccggaaacccctttaaaaccgtttaaacccttaaccgtttaacgttaaacccgtaaaaccgttaacggttaaacccggtttaaaccctaaacccccggttaacccccgttaccgggttacctttaacccggttaacccggtttaccggggaaccggggttaaacggggaacccgtaaggggtaacggtaaacgtaaccgtaaacgtaaaaccggtacgttggtaccggacttacccgg

SEQ ID NO: 331402 - DNA, 654 bp, Homo sapiens
  misc_feature: GZ8MTXP02HHZXV.17.57.F02.1.454.CMB.2.raw
  modified_base (201)..(201): a, c, t, g, unknown or other
  misc_feature (201)..(201): n is a, c, g, or t
  modified_base (430)..(430): a, c, t, g, unknown or other
  misc_feature (430)..(430): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatctcttcggccggacaagtcagagcattagacttaaactttttaagtggtatcgaggaccgggaaaccagggaaacctacccctaaatcctagtactctaatactgacctacttacctaagttcgaacgtaaaggtcgggtacccagtaccgtaaggttcaggtcggactaggtcgggattcggacggtactagttacttcctactcctacctaactntacgaggtcctagtctacgacctaacgtgtaagttactttacgtaaccttaacgtttactacgttacgttaaacctacggttaacgggttaacctaacccggttaccgttaaccgttacgtttacgggacccggttaaacgggaccgtaaggtccgtaggaaacgttacgaacgtaaaacggtcgtaacgtcggttaccacggaacctacgtcttacgtttccg

SEQ ID NO: 331403 - DNA, 639 bp, Homo sapiens
  misc_feature: GZ8MTXP02IHQ8A.17.57.F02.1.454.CMB.2.raw
  modified_base (230)..(230): a, c, t, g, unknown or other
  misc_feature (230)..(230): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagacgtcaaccatctcttggcccggganaagtcagagctattagtactaacttttttaaatggtatacgaggaccggaaaccgagggaaaccgcccctaaactcctagactactatactgactatacctaatttcgactaaaggtcgggtcccagtacgaaggttcaggtgacagtggatcgagggacagtactttcactctacacctatcgagctagtcctagacctaacgtgacggttattttacgaaccttaaaccgtttattaaccgttgtaaaccgtaaaccggtacgggtttaacctaacccggtttaacccccgttagtttaaccggttttcgggaaccccgtaaagggggtaccctaaaggccgttaaagggaacgtacttaaaccgaaacgtacgttcggtacgcgttacgactacctattacgttcg

SEQ ID NO: 331404 - DNA, 697 bp, Homo sapiens
  misc_feature: GZ8MTXP02JK1IT.17.57.F02.1.454.CMB.2.raw
  modified_base (229)..(229): a, c, t, g, unknown or other
  misc_feature (229)..(229): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcactatctcttcggccggganaagtcagagacattagactaactttttaaatggtatcgaggacggaaccagggaacacccctaaactcctgatactatactgactactactaagtttgaacgtaaaggtcggggtacctacgtacgaagggtttacaggtcggacagggtcggattacggtaggggaactagttacttacctaccgttactaccaaccgtactaccgacgtaccgtagttaccgtacggtaaccctaaccgttaggaaacgggtttactttttacggaaacccttaaaaccttttaccttacgttacggttaaacccgtaaacgtaaccggggtttaaaccctaaccgttaaccccggttaaccgttacgttttaccgggacccggtaaacggggtaacccgtaggaccgttagggaaacgtacgtaaaccgtaaaaccggtgtaacggtcgacgtacgacctacgtacttacgttcg

SEQ ID NO: 331405 - DNA, 756 bp, Homo sapiens
  misc_feature: GZ8MTXP02JDSML.17.57.F02.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatctcttgccgggnaagtcagagcattagctaaactttttaaatggtatcaggcggaaccagggaaacacccctaaactcctgacttctatactgctatacctaaatttcgaacgtaaaggtcggggtacccctaagtaccgtaaacgggtttaccaagggttcgggaccgtaggttaggggtaactttccggggtacgggggtaaactaacgggttaaccttttaccgtaacctttaccttacccaaaccctaacttaccgaaacgccgttaaacggttccttacgggaccctaaacccgttgggtaacggtttacgtttttacgaacccttaaaaccttttaccgttaaccgtttacggtaaacccgtaaaacgggttaaacccgggtttaaaccgtaaacccggggtttaaaccccccgttaaacgtttaccggttttaccggggaacccggtaacgggggaacccctaaaggtcccggtagggaaactacgtaacgaaaacgtacgtggtacgcgtacgacctacgacttcgttactactttc

SEQ ID NO: 331406 - DNA, 590 bp, Homo sapiens
  misc_feature: GZ8MTXP02H6SXC.17.57.F02.1.454.CMB.2.raw
  modified_base (273)..(273): a, c, t, g, unknown or other
  misc_feature (273)..(273): n is a, c, g, or t
tcagcgtagactagcacgaccggtgctcgatttagctcgatatagttgggtttgggggcaggagtcagtctcagtcaggacacagcatggacatgagggtccccgctcagctcctgggctcctgctactctggctccgaggtgccagatgtgacatccagatgacccagtctccatcctcctgtctgcatctgtaggagacagagtcacatctcttgccgggcaagtcagagcattagctaacttttaaatggtatcagcggaacagggaacnccctaaactcctagatactatactgactatacctaatttgactaaacggtcggggtacccagtacgtaaacggttcaagtggacaggtggatacgtggggacagtactttacacttctcacctatacgagctaagtctgaccaacttgagttaattttgactaactttactactgtaccaaacgtagggttaaccacgtaacccgttagtaccgtttggacccgtaaggggaccaaaggtcgtacgggaaacgttaacgtaaaccgtaaaaccgtacgtggtacggtactacggaccctaaccgtagtttaccgtcg

SEQ ID NO: 331407 - DNA, 576 bp, Homo sapiens
  misc_feature: GZ8MTXP02IFTB7.17.57.F02.1.454.CMB.2.raw
  modified_base (199)..(199): a, c, t, g, unknown or other
  misc_feature (199)..(199): n is a, c, g, or t
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatcgacccagtcctccatcctccctgtctgcatctgtagganacagatcacatctctgccggcaagtcagagcattagacttaacttttaaatggtatcaggacggaaccagggaaacncccctaaactctagatctatactncactctaatttgactaaaggtcgggtacccagtacgtaaggttccgagtggcgtagtggactggtgggactagtatttcacttcncacatcacgnagtctgaccactgagttattgacttacgttactattgactaacgtaggtacctacgttaccctaacgttcgtttaggaccgtaacggggaacaaacggtcgtaggtaagtaaacgtacaaaacccggtaagttcgcgggtaacctacggacctaaacctacgtttccgtctttaccctacc

SEQ ID NO: 331408 - DNA, 580 bp, Homo sapiens
  misc_feature: GZ8MTXP02FH63K.17.57.F02.1.454.CMB.2.raw
  modified_base (375)..(375): a, c, t, g, unknown or other
  misc_feature (375)..(375): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (481)..(481): a, c, t, g, unknown or other
  misc_feature (481)..(481): n is a, c, g, or t
  modified_base (516)..(516): a, c, t, g, unknown or other
  misc_feature (516)..(516): n is a, c, g, or t
tcagcgtagactagcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccgccaacatacgccttctcccgtccccccttgcagtaacaccaagtacagaatataacctgttcccatcgactacgccttcggcctcgccttaggggcactcaccctgccccgattaacgtggacaggacccttggcttccggcgagcggcttttcacccgtntttactcgttaccttatgtcagcattcgctacttctgtactacctcaagcatcgcctcacagcacncttcacngctacagaaccncctacccctaaccaacgaacncaactaacgcgtcgctacgccgacacgcgttcggnacctagttacggtttaaccgtccccgttcacttccgttccccactactcttacgacttacgtcc

SEQ ID NO: 331409 - DNA, 813 bp, Homo sapiens
  misc_feature: GZ8MTXP02FH3NZ.17.57.F02.1.454.CMB.2.raw
  modified_base (198)..(198): a, c, t, g, unknown or other
  misc_feature (198)..(198): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaaactttttaaattggtatcaggacgggaaccgaagggaaacgacccctaaaactcctagatctatactgactatacctaatttcgacgtaaaaggttcggggtacccctaagttacgtaaacgggtttccgaaggttgggaccgtaagggttggggaactttcgggtacgggggtaaacctaaggttaactttttcccaacctttccctaaccctaacccaattacccgaagggtcctaacggttccgttacggaacccgttaaacccgttaggggtaaggggttaactttttacgggaacctttaaaaccttttaaaccttaacgttacggttacccgaaaaaccgggttaacgggggtttaaaccctaaccgggtttaaacccccccggtttaacgttaacccggttttttaccggggacccccggttaaacggggggaaaaccccctaaaagggtacccggttaggggaaacgtaaacgttaaacccggaaaaaccgggtaaccgtgggttaacgggccgttacgggaccctaaacccgtactttaccgttacggttccctttaacccg

SEQ ID NO: 331410 - DNA, 728 bp, Homo sapiens
  misc_feature: GZ8MTXP02IOHE4.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccactcctccctgtctgcatctgtaggagacagagtcactatctcgttgcgggacaagtcagagctattacgacttaaactttttaaagtggtatacgaggaccgggaaaccgaagggaaaaccgacccctaaacgttcctagtacttacgtaactacgtgacctaacttacctaaatttcggaaacgtaaaggtccggggtaccaagtacgtaagttcgaggtggacgtaggtggtactacggtacgggactaacggttctttaccaccttacctacccaaacctacgttacgacgtaccgtaagttccgtacgtaaccgtaaaccgttgggtaacggtttacttttacggaaacctttaaactttaaccgtacgttacggtaaaccgtaaacggtaacgggttaaccctaacccggtttaacccccgttaattaccggtttcggaacccggtaaacgggtaccctaagggaccgttaagggaaactaacgtaaaaccgtaaaaccggttacgtgggtacgtacgtaccgaccgtaactacgtttacctttccg

SEQ ID NO: 331411 - DNA, 587 bp, Homo sapiens
  misc_feature: GZ8MTXP02GU66P.17.57.F02.1.454.CMB.2.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatctctgccggnaagtcagagcattagcttaaacttttaaatggtatcgaggaccgggaaaccaagggaaacacccctaaactcctagatctatactgacatcctaatttgactaaaggtcggtaccagtacgaagttcaggtggacaggtggatcgtagggactagtatttcactcncacntcagctagtctagacctaacgtagtagttatttgaaccttaacttactacgtagtactaaacggtacggttaacctaccggttaaccccgttagttacgtttacggacccggtaacgggggtacccaaggtcgtaggaagtaactaaccgaaacggtactggtacggtactacgacctacgtcttcgttacg

SEQ ID NO: 331412 - DNA, 615 bp, Homo sapiens
  misc_feature: GZ8MTXP02GP72A.17.57.F02.1.454.CMB.2.raw
  modified_base (106)..(106): a, c, t, g, unknown or other
  misc_feature (106)..(106): n is a, c, g, or t
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (482)..(482): a, c, t, g, unknown or other
  misc_feature (482)..(482): n is a, c, g, or t
tcagcgtagactagcacgaccggtgctcgatttagctcgatatagttgggtttgggggcaggagtcagtctcagtcaggacacagcatggacatgagggtccccgntcagctcctggggctcctgctactctggctccgaggtgccagatgtgacatccagactgacccagtcctccatccctcctgtctgcatctgtagganacagatccacatctcttggccggnaagtcagagactattagtacttaacttttaaatcggtactacgaggacgggaaaccaaggggaaaccgtacccctaaactcctagtaacttctaatactgactacttacctaaatttgaacgtaaggtcggggtaccctaacgtaccgtaaggttcaggttcggactaggtgggtactcggtaggggactagtacgtttccacttacctactaccagtcagactaggtccagactaaccgtgtacggttatttanaccttaacttcgtactagtacaaaccgtggttaaccacgttacctactacgtttaggaccgtacgggaacccaaggtcgtacggagtaacctaacggaaactacggtgtacgtactagacctactcttacgtc

SEQ ID NO: 331413 - DNA, 600 bp, Homo sapiens
  misc_feature: GZ8MTXP02IETX8.17.57.F02.1.454.CMB.2.raw
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (278)..(278): a, c, t, g, unknown or other
  misc_feature (278)..(278): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagatcacatctctgcgganagtcagagcattagactaaactttttaaatggtatcgaggacggaaaccaggaacncccctaaactcctagatactatactgactatacctaatttgaacctaaaggtcgggtaccctagtacgtaaggttcaggtggcgaggtggtattcggtagggactagttactttacaccgtctacaactatcacgtctacgtctgaacctaaccgtggagttattttcgaaccttaatttaacacgtgtaaccaaggttaggttaccacggttacccctaagttccgtttacggaaccggtacggggaacctaggccttagggaactaacgttaacgaaaacgtcgtaaggtcgtacgtacgactaacctctttcgttaccg

SEQ ID NO: 331414 - DNA, 650 bp, Homo sapiens
  misc_feature: GZ8MTXP02HXNUE.17.57.F02.1.454.CMB.2.raw
  modified_base (229)..(229): a, c, t, g, unknown or other
  misc_feature (229)..(229): n is a, c, g, or t
  modified_base (419)..(419): a, c, t, g, unknown or other
  misc_feature (419)..(419): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatctctggccggganaaggtcagagctattagacttaaactttttaaagtggtatacgaggacggaaaccgaagggaaacgtacccctaaaactccgtgaactactaattactcgactactacctaatttcgacgtaaaggtcggggtacccatacgtaaaggtttcaggtacggagtagtgggatcgtagggacctagtcttanaccttacacaacccgataccagctagtacctgactaacgtgtaagttacttttacgaacttaacctttaacgtacgttggtaacctaaacggtaacgggttaacctaaccggtaaccccgttaaccttaacgggtttacgaaccggtaaccggggaaacctaaagggccttaagggaactaacgtaaccgaaaacgtagtaacggtgactcgactaacctacgtacgttcg

SEQ ID NO: 331415 - DNA, 657 bp, Homo sapiens
  misc_feature: GZ8MTXP02JFVMG.17.57.F02.1.454.CMB.2.raw
tcagcgtagactagcacgaccggtgctcgatttagctcgatatagttggggtttgggggcaggagtcagtctcagtcaggacacagcatggacatgagggtccccgctcagctcctggggctcctgctactctggctccggaggtgccagatgtgacatccagatgacccagtctccatcctccctgtctgcatctggtaggagacagagtcaccatctcttggccgggacaagtcagagcattagacttaaacttttaatggtatcgaggacgggaaaccagggaaacacccctaaactcctagatctatactgactatacctaatttcgaacgtaaagggtcggggtaccctagtacgtaaggttcaggtggactaggtggatcggtagggacagtatttccacttctacaccatcgatctacgtctacgactaaccgtaggtaacggttaatttcggaacttaaacccgtttactaaccgttagtaaaccgtaaaaccggttacggggtttaaccctaaccggtttaacccccgttaacgttaccggtttacgggaaccggtaacgggggaaccctaagggtaccgtagggaaacgtaacgttaaccgaaaacgtacgtggtacggtcctacggacctacgtaacgtctttacg

SEQ ID NO: 331416 - DNA, 630 bp, Homo sapiens
  misc_feature: GZ8MTXP02IB2GF.17.57.F02.1.454.CMB.2.raw
  modified_base (215)..(215): a, c, t, g, unknown or other
  misc_feature (215)..(215): n is a, c, g, or t
tcagcgtagactagcacgaccggtgctcgatttagctcgatatagttgggtttggggggagtcagtctcagtcaggacacagcatggacatgagggtcccgctcagctcctggggctcctgctactctggctccgaggtgccagatgtgacatccagatcgaccagtctccatcctccctgtctgcatctaggtaggagacagagtcaccatctnttgccgggacaagtcagagctattagacttaattttaaatggtatcagacggaacagggaaactaccctaaacgtccagactactatactgactaactacctaaatttggaactaaagggttacggggtacccctaatacgaaacggttcaaggttggacaggttggaacttcggtacggggaactacggttatttaccacctttacgtaccaacctagtaccgaacgtacgtacgtacgtacgtacgtaacgtaggtacgttacgttactaactaacttaactactacgtaacgtaacgtacggtacgtaccgtaaccgttacgttacgttacgtacggtacggacgaacgtacgtagaacgtaacgtaactaacgtacgtacgtacgtcgacgtactactactactcgtactc

SEQ ID NO: 331417 - DNA, 610 bp, Homo sapiens
  misc_feature: GZ8MTXP02JZEKH.17.57.F02.1.454.CMB.2.raw
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtctccatcctccctgtctgcatctgtacccgganacagagtcacatctcgtgccgganaagtcagagctattagacttaaactttttaaagtggtatcgaaggacggtaaaccgaagggaaaccacccctaaactcctagactctaatactgactatacctaagtttcgacgtaaaggtcggggtacctagtacgtaaggtcaggtggactaggtggactcggtaggactagtactttcgactctacacctatacgagcagtctgaccaactgagttatttcgactaacttacacgttagtaaccaacgttacgggttaccaacccggttaacccgtacgttacgtttacggaacccggtaacgggggtaacccaaggtcgtaaacgggactaacgtaacgaaaacgtacgtcggtacgactacgacacctatctttcg

SEQ ID NO: 331418 - DNA, 564 bp, Homo sapiens
  misc_feature: GZ8MTXP02I97QB.17.57.F02.1.454.CMB.2.raw
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
  modified_base (286)..(286): a, c, t, g, unknown or other
  misc_feature (286)..(286): n is a, c, g, or t
  modified_base (411)..(411): a, c, t, g, unknown or other
  misc_feature (411)..(411): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatccctccctgtctgcatctgtaaggaaacngatcaccatctcttggccggganaagtcagagactattagactaactttttaaatggtatcaggcgggaaccaagggaaacncccctaaactcctgatctatactgctatcctaatttgactaaaggttcgggtaccatacgaacggttccaggtgcaggtggactgtggggactagtatttccactctacaccactcgagcagtcngtactaaccgtgtaggtatttagacttaaactttactatacgtacaacgtacgggttaaccacgttaccccgtattacgtttacggacgaacggggaccaggtcgtggaatactaacgaaacgtcgtgtcgactcgcactatctcgtctactc

SEQ ID NO: 331419 - DNA, 687 bp, Homo sapiens
  misc_feature: GZ8MTXP02I803Z.17.57.F02.1.454.CMB.2.raw
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtcctccatccctccctgtctgcatctggtaggagacagacgtccacctattcctcgttcggccgggacaagtcaagacgtacaattagacttaaactttttaagtggtatcgaggacgggaaaccgaagggaaacgacccctaaaactccgtagtactcctaagtactgactactacctaagtttcgacgtaaacgggttcggggtaccctaaagttccgtaaaacggttccgaggttcggactaggtaggtactcgggtaggaactagtactttaccgactctaccaacctataccgagtcaacgttccgacgtaaccctaacgttggtaacggttactttacgaaaccttaaactttacgtacgttcgtaacctaaacgggtacgggttaaacctaccggttaaccccgttacgttacgtttacggaaccggtaacggggaacctaacgtcggtacggaagtaaactacgaaaacgtacgtggtacgccgtagacctacacttctacgttcttaccg

SEQ ID NO: 331420 - DNA, 509 bp, Homo sapiens
  misc_feature: GZ8MTXP02JEPAU.17.57.F02.1.454.CMB.2.raw
  modified_base (197)..(197): a, c, t, g, unknown or other
  misc_feature (197)..(197): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatctcttgccgggcaagtcagagcattagctaacttttaatgtatcagcggaacaggaacgcccctaaactcctgatctatactgcatccaatttgacaaagtgggtcccatcaagttcagtgcagtgatcgtagggacagtattcactctcaccatcagcatctgcaactgagtatttgactaacttactactgtacaacgtaggttacacgtacccgtactacgtttcggacctaggggaccaagcgtaggacgatacgaaacgactgacggctacggacactatcttacgtactttac

SEQ ID NO: 331421 - DNA, 655 bp, Homo sapiens
  misc_feature: GZ8MTXP02JFH61.17.57.F02.1.454.CMB.2.raw
  modified_base (142)..(142): a, c, t, g, unknown or other
  misc_feature (142)..(142): n is a, c, g, or t
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (316)..(316): a, c, t, g, unknown or other
  misc_feature (316)..(316): n is a, c, g, or t
  modified_base (517)..(517): a, c, t, g, unknown or other
  misc_feature (517)..(517): n is a, c, g, or t
  modified_base (639)..(639): a, c, t, g, unknown or other
  misc_feature (639)..(639): n is a, c, g, or t
tcagcgtagactagcacgaccggtgctcgatttagctcgatatagttggggtttggggggagtcagtctcagtcaggacacagcatggacatgagggtccccgctcagctcctggggctcctgctactctggctccgaggtnccagatgtgacatccagatgacccagtcctccatcctcctgtctgcatctgtagganacagagtcacctatctcgtggccggganaagtcagagctaagttagacttaaacttttaaagtggtaatcgaggacgggaacaggaaaccgaccctaaactcctagactactatacngctaactacctaagtttcgaacgtaaaaggtcggggtacccaagtacgtaacggtcaggtcggactaggtgtactcggtaggactagtacttccacttctaccgaaccctatacgacgactacggtctacgacgtaacgtgtacggttatttacgaacttaacttaactacgttgaaccgtaaacggtacgggttaaaccncccggttaaaccccgtacgttacggtttaccgggaaccggaacggggtaacccgtaaaagtccggtaaggaaaccgtacttaaacgaaaacgtacgtggtaacgcgtaacgactaaccgttnttacgtacgttactac

SEQ ID NO: 331422 - DNA, 635 bp, Homo sapiens
  misc_feature: GZ8MTXP02G4TDK.17.57.F02.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (233)..(234): a, c, t, g, unknown or other
  misc_feature (233)..(234): n is a, c, g, or t
  modified_base (297)..(297): a, c, t, g, unknown or other
  misc_feature (297)..(297): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccactccctccctgtctgcatctgtagganacagatcacntctctcgcggnagcagannatagactaactttaatgtatcgagacggaacaggaacacccctaaactcctagatctatactnactatacctaattcgaacgtaacggtcggtacctagtacgtaagtcaggtcggacgtaggtggatcggacggactagtactttaccactcctcacctatcgatctagtctagaccgtaacgtagtaaggttacttactaaccttaaacgtttactacgttacgtaaccgtaaacggtaacggttaacctaaccggttacccgttaacgttaccggtttacgggaacccggtaacggggaaaccctaagggtaccgtaagggtaaacgtaacgtaaaccgtaaaaccggtaacgtcggtaacggtacgtacgtaaccctaaccgtcgttaacctttccg

SEQ ID NO: 331423 - DNA, 730 bp, Homo sapiens
  misc_feature: GZ8MTXP02HFWZ4.17.57.F02.1.454.CMB.2.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (267)..(267): a, c, t, g, unknown or other
  misc_feature (267)..(267): n is a, c, g, or t
  modified_base (474)..(474): a, c, t, g, unknown or other
  misc_feature (474)..(474): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgagganacagagtcacatctnttgcggcaagtcagagcattagctaattttaatggtatcagcggaacaaggaacnccctaaactcctagatctataactgacactacctaaattttgaacgtaaaacggtcggggttaccccaagttaccgtaaagggtttcaacggttacgggacgtaaggttgggacgtttccggtaacgggggtaacctaaacggttattttacccgaccttacctaaccctaccctaacttacgtacgaccgtacgttaacccgttanaacccgaacccttaggtaaaccgggtttattttacggtaaccgtaaaactttaccgttaacgtttacgttaaacccgtaaacgttaacgggggtttaaccctaaccggttaaacccccggttactaaccggtttttccggaaccggttaacgggggaaacccgttaaaccgggacgtacggaacgtaaacgtaaccgtaaacgtaacgtacggtacgtaacgtacgtaccgtacgtacttcgtaccgttacgtacg

SEQ ID NO: 331424 - DNA, 709 bp, Homo sapiens
  misc_feature: GZ8MTXP02HTPVJ.17.57.F02.1.454.CMB.2.raw
  modified_base (200)..(200): a, c, t, g, unknown or other
  misc_feature (200)..(200): n is a, c, g, or t
  modified_base (410)..(410): a, c, t, g, unknown or other
  misc_feature (410)..(410): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatccctcctgtctgcatctggtagganacagagtcaaccattctcgttcggcccgggataaacgtcaagagctattagtacttaaacttttaaagtggtatacgaggaccgggaacgagggaaacctacccctaaactcctagtactctatacgagtactacttacctaagtttcgaacgtaaagggtcgggtacccctagtacgtaacggttcgaggttcggacgtaggtacggtntcggtaggggactagttactttcaaccttctacccactatcgtagactagtcctacgacctaccgtagtacggtttatttacacctttaaacctttaccttaacgttacgtaaccgtaaacgggttacgggttaacccgaaccggtttacccccggttaaccgtttacggtttaccgggaacccgggttaacgggggaaaccctagggaccgttagggaaaccgtaaccgtaaaccgtaaacggtaccgttaggtcggtaaccgtacgacctacgtacttccgttacgttcctttaccg

SEQ ID NO: 331425 - DNA, 668 bp, Homo sapiens
  misc_feature: GZ8MTXP02GU1UR.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctctggccggnaagtcagagctaattagacttaacttttaaatggtatcaggaccggaaacgagggaaactccccgtaaactccgtgactctaactactgacctattacctaaagtttcgaactaaacggtccggggttaccctagtacgaaacggtttcaacggtggccgtaaggtgggtactacggtaccggggaatagttaactttcctacctttacccacccaaccttaactacgacggactaacggtcgttacaaaccgtaaacctaggtaaccggtttattttaacgaacccttaaactttacgtacttaacgggtaaacctaaacgtaacgggttaacctaccgttaaaccccgtagttaacgtttacggacccggtaaagggaccctagaccgtaggtaaacacgttaccgaaagtaacgtgtacgcttacgccctaatcgttctcg

SEQ ID NO: 331426 - DNA, 572 bp, Homo sapiens
  misc_feature: GZ8MTXP02GHCP3.17.57.F02.1.454.CMB.2.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (423)..(423): a, c, t, g, unknown or other
  misc_feature (423)..(423): n is a, c, g, or t
  modified_base (487)..(487): a, c, t, g, unknown or other
  misc_feature (487)..(487): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtctccatcctcctgtctgcatctggtagganacagacgtcaccatcttcgttcggccgggnaacgtcagagctattacgnttaaactttttaaagtggtatcgagacggaacagggaacncccctaaancctagatcgtatacnacactacctaatttcgaactaaaggtcggggtacctaagtcgtaacggttcagtggactaggtcgggtatcggtagggatagtactttcacttcactacatcagcagtcgnacaacgtgaggttacttgaactaacgttactagtactacaacgtaggtaaccacgtaacccgtnttacggttgacgtaaggggtaccaagtcgtagacgtaaactcgaaaacgtctgggacgtctcgacgtacactcgttctcttaccc

SEQ ID NO: 331427 - DNA, 594 bp, Homo sapiens
  misc_feature: GZ8MTXP02JSEG0.17.57.F02.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (272)..(272): a, c, t, g, unknown or other
  misc_feature (272)..(272): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtcctccatcctcctgtctgcatctgtagganacagagtcaccatctcttgccgggnaagtcagagctattagctaacttttaatggtatcagcggaacaggaacnccctaaactcctagactctatactgactatacctaatttggactaaaggtcggggtacccatacgaacggttcaggtcggcaggtgggactcgtaggggacaggtctttacacttctacacccattaccagtctaacggtctagacctaaacgttgaacggttattttacgacttaaacttactacgtcgtacgtaaacggtacgggttaccaccggtttaaccccgtacgtttacgtttacgggaccgtaaggggaaccctaggacgtggaaactactaacgaacgtacgtggtacgctacgcactatcgtacttcaaacc

SEQ ID NO: 331428 - DNA, 745 bp, Homo sapiens
  misc_feature: GZ8MTXP02HOX44.17.57.F02.1.454.CMB.2.raw
  modified_base (206)..(206): a, c, t, g, unknown or other
  misc_feature (206)..(206): n is a, c, g, or t
  modified_base (720)..(720): a, c, t, g, unknown or other
  misc_feature (720)..(720): n is a, c, g, or t
tcagcgtagactagcacgaccggtgctcgatttagctcgatatagttgggtttgggggcaggagtcagtctcagtcaggacacagcatggacatgagggtccccgctcagctcctggggcctcctgctactctggctccgaggtgccagatgtgacatccagatcgacccagtcctccactccctccctgtctgcatctgtagganacagactccacctattccgtcgttcggccgggtacaagtcgagacgactaattagtactttaaacgtttttaaagtaggtactacgaacggtaaccgggaaaccggaacgggaaaacccgtacccccttaaactccgtactacgtactaacttacgtcgtactaccttaaccgtaatttacggaaacgttaacggttaccggggtaacctagtaccggttaaggttaccgaaggttcggacggtagtacggggttacgtacgggtacggtaaccgttaaggttacctttaaccgtacccgttacttaacccggaaacccgttcttaacccggacgtaccgttacggtttaccgacgttaaaccccgtaacgggttagtacgtttagttacccgtaaacttaccgtttacgtacgttacgtaaccgtaaacggttacggtacctaaccgttacccgttagtacggttacgaccggtaacggtacgtagcgttaggaactaacgacgtaacgtagngtcgacctacacctcactttcctag

SEQ ID NO: 331429 - DNA, 604 bp, Homo sapiens
  misc_feature: GZ8MTXP02IPP8B.17.57.F02.1.454.CMB.2.raw
  modified_base (228)..(228): a, c, t, g, unknown or other
  misc_feature (228)..(228): n is a, c, g, or t
tcagcgtagactagcacgaccggtgctcgatttagctcgatatagttgggtttgggggcaggagtcagtctcagtcaggacacagcatggacatgacgggtccccgctcagctcctggggctcctgctactctggctccgaggtgccagatgtgacatccagatgacccagtctccatccctcctgtctgcatctgtaggagacagagtcacatctcttcggccgganaagtcaagagactaattagacttaaactttttaaagtggtatacgaggaccgggaaacaacgggaaacaccccctaaatcctagtactactaatactagacctattaccaatttcgaaactaaaggtcggtacctatacgtaagtcagtgactagtggatcggaggacagttacttacactctacacctatacagtccagttcagaacctaccgtagtagttaacttttacgactaaacgtttactacttagaaccgtaagtacgggttaacctaacggttaacccttacttacgtttacggaccgtaacgggggaccaagtctaaggactaacgtacgaaaacgtctaagtcggctagacctacgtactacgtcg

SEQ ID NO: 331430 - DNA, 628 bp, Homo sapiens
  misc_feature: GZ8MTXP02GB8UV.17.57.F02.1.454.CMB.2.raw
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatctctgccggnaagtcagngcattagctaaacttttaatgtatcgaggacggaaaccaggaaacncccctaaatcctagactctatacgtgacactacctaaatttcgaaactaaagggtcggtacccaagtcctaaaggttcaaggttcgcgtaaggtcgatcggtagggactagtactttcacgttctaccactactcgagtcccgtaagtcctaggtacctaaccgtagtaggttaacttttcgaaaccttaactttcgtaacgtgtaacctaaaacggttcggtttaaacaacccggttaacccctaagttacccgtttaggggacccgaaggggtaacccaggtcgtaaggacgtaaccttaacgaaaaccggtcgttgtacgactaccgacgtaccttaggtcctttacg

SEQ ID NO: 331431 - DNA, 797 bp, Homo sapiens
  misc_feature: GZ8MTXP02J2Z7F.17.57.F02.1.454.CMB.2.raw
  modified_base (204)..(204): a, c, t, g, unknown or other
  misc_feature (204)..(204): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtctccatcctcctgtctgcattctaggtagganacgagacgtccacctatccttcgttcggccgggtactaagtcgaagacgcctaattacgtacttaaaacgtttttaaagtcggtactacgaacggtaccgggaaaccgaacgggtaaaccgacccccttaaacgtccgtagtactacctaataccgtgtaccacgttaacctaagtttacgaacgtaacggtcgggtacctagtaccgtaaggttcgaaggtcgacgtaggtcgtgtacggtggactagtctttacactcttaccactacgtacacgtctaacggtcctacgtacccgtaaaccgtaggggttaactttaccgttttaacggtaacccgttaaactttaccgttaacgttaccggtttaaaccggaaaaccgtttacccgggggtttaaacctaacccccggttttaaaccccgttaccggttaaccggttttaccgggggaaaacccggtttacccgggaaaccgttaaacggggcgtttaaacggggaaacggtaacctaaaacgggtaaaaccgttaaacggtcgggttaaccggaaccggtttcgaaccccgttaccttaacggttccctttaacccgg

SEQ ID NO: 331432 - DNA, 635 bp, Homo sapiens
  misc_feature: GZ8MTXP02HE78X.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgaccccagtcctccatccctccctgtctgctatctgtaggagacagagtccactatctcgttcggccgggacaagtcagagctattagtacttaactttttaatgtatacgaggacggaacgaaggaaccaccctaactcgtgactactatctgctactactattcgacgtaaggtcggtccagtacaggtcaggtgctaggtgacgtgacgggtactagttacttcactctacacatcagctacgtcacggtactaaccgtagtaacggtttacttacgtacttaacctttaacgtaccgttacgtaaaccgtaaacgtaaccgggtttaaccgtaacccggttaccccgttaacgtttaccgtttacggaacccggtacgggggtaacccaggtaccgtagggaacctacgtaaaccgaaacgtacggtcgtacggtaccacggtaaccctacgttacgtcgtttaccg

SEQ ID NO: 331433 - DNA, 843 bp, Homo sapiens
  misc_feature: GZ8MTXP02GPE5X.17.57.F02.1.454.CMB.2.raw
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccactccctccctgtctgcatctgtagganacagagtcacatctctcgccggganagtcagagctattagacttaaacttttaaagtggtatacgacggaccgggaaacgaacggaaaccgacccctaactccgtagtacttactaactactacgacctactacctaagtttaccgaacgtaaacgggttccggggtacccctaagttaccgtaacggtttacgaaaggggtcggtacgtacgggttggggtaacttcgggtacggggtaactaacggttactttacgacccttacctacaaccctacgtacgacgtacgtaccggttacctacggtaaccctaaaccgggtttagtaaagggttttaacgttttaccgaaacccttttaaaacccggttttaaaccttaacccggttaccggttaaacccggttaaaacccgggtttaaccggggtttaaacccgttaaacccccgggttttaaacccccggttaacgttttaacccggggttttaccggggaaaccccggggttaaaaccgggggaacccttaaacggggtaaccggttaaaggaaaccgtaaacgtaaaacccggtaaaacggttaacccggttgggtaaccgtcccggtttaccgaaccgtaccgtttaaccgtcctttaaccgg

SEQ ID NO: 331434 - DNA, 554 bp, Homo sapiens
  misc_feature: GZ8MTXP02FG0UX.17.57.F02.1.454.CMB.2.raw
  modified_base (223)..(223): a, c, t, g, unknown or other
  misc_feature (223)..(223): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcacatctctgccggnaagtcagagcattagacttaacttttaaattggtatcaggacgggaaaccgagggaaacgaccccctaaaactcctgatctatactgacatcaagtttgacaaaggtcggggtaccatcgtaaggtcaggtggcaggtggatcgtggggaacagtactttaccactacctacaccgtatacagactagtctacgactaacctagacggtaattttgaactaactttatacttagtacaacgtaacggttactacgtacccgtactacgtttcggaccgacgggtaccagctaggacacacgaagacgtgtacgcgtacgcacactcgttac

SEQ ID NO: 331435 - DNA, 666 bp, Homo sapiens
  misc_feature: GZ8MTXP02HRCKS.17.57.F02.1.454.CMB.2.raw
  modified_base (200)..(200): a, c, t, g, unknown or other
  misc_feature (200)..(200): n is a, c, g, or t
  modified_base (316)..(316): a, c, t, g, unknown or other
  misc_feature (316)..(316): n is a, c, g, or t
  modified_base (651)..(651): a, c, t, g, unknown or other
  misc_feature (651)..(651): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtcctccatccctcctgtctgcatctgtagganacagagtccacatctcttcggccggacaagtcagagtctattagacttaaacttttaagtggtatcgaggtaacggaaccgaaggaaaccgaccctaaactctagattactatacngactacttacctagtttacgaacgtaaaggtcggtacccagtacgaccggttacgaggtggacgtaaggtggtaactcggggtaggtaacaggtttacctttacacctacctaccaaccctaagttccgaaacgtcctaaagttccgttaacgaccgttaaacgtaggtaaccgtttagttttacgaaccttaaactttactacgtttacgtaactaaacggttacggttaactacccggtaaccgttacgttacgtttcggaccggtaagggaaccgtacggtacgtggaaacgtattaaccgaaaagtccgtagtcgaacgacgtccaacgtnttacgtcttacttcg

SEQ ID NO: 331436 - DNA, 754 bp, Homo sapiens
  misc_feature: GZ8MTXP02FMRRA.17.57.F02.1.454.CMB.2.raw
  modified_base (740)..(740): a, c, t, g, unknown or other
  misc_feature (740)..(740): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatcgacccagtcctccacttccctccctgtctgcatctggtaggagacagagtccaacctatcttcgttcggcccgggacaagtcgaagacgactaagttaacgtacttaaacgtttttaaagttggtaactcgaaggaccggggaaaccgaacgggaaaccgtacccctaaactccgtagactacgtactactcgactactaccttaattacgaacgtaaacgggtccgggtacctaagttacgtaaccgggtcgtaggtcggacgtaggtacggacttcgggtacggggaaacttaacggttactttacctacgttccctaaccaaacctatacccgaggtacctacggttcctacgaaccgtaaaccggttagggtaaggttaaactttcgaaacctttaaaccttaccgttaacgttacgtaaaccgtaaacgggttaaggttaaccccgtaacggtttaacccccgtaacgtttaccgggtttccggggaaaaccgtaacgggggtaacctaaggaccggttaggaaaacggtacttaaacggaaaacgtcgtcggtaccgcgtacgacaaccgttntacctcgtactacg

SEQ ID NO: 331437 - DNA, 597 bp, Homo sapiens
  misc_feature: GZ8MTXP02G1O0Z.17.57.F02.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccactccctcctgtctgcatctgagganacagagtcacatctctcggccggnaagtcaganctattagcttaaattttaatggtatacgaggacggaacgaggaaaccnccctaacnctagatactatctgactactctaattgaacgtaagtcgggtaccataccgtaagtcgtaaggtgacgaggtgtacgtggtaggggactagtactttcacgtactcaccctanacgngactacgtctcgacgtagtagtaacgttacttacgtaactaacttactacgttacgtaacgtaacgttaacgttaccgtaaccgttacccgttacgttaccgttacggacggtaacgggactacggtacgacggtaacgtactaaccgtaacgacgttaacggtcgactacgactaccgtacttcgttacc

SEQ ID NO: 331438 - DNA, 589 bp, Homo sapiens
  misc_feature: GZ8MTXP02IQO77.17.57.F02.1.454.CMB.2.raw
  modified_base (420)..(420): a, c, t, g, unknown or other
  misc_feature (420)..(420): n is a, c, g, or t
tcagcgtagactagcacgaccggtgctcgatttagctcgatatagttggggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatctcttgccgggcaagtcagagcattagactaaatttttaaatggtatcaggacggaaccagggaaacgacccctaaactcctagatactatactgactatcctaaatttgactaaaaggtcggggtacccaagtacgtaaacgggtttcaggtggctaggttggactcgtaggggacagtactttccactctacacctatcagcagtcngcaacgtgtagtatttcgactaaacttactactagtacctaacggtacggttaacaccggttaccccgtattacgtttggacgtaacggggaccaaaggtcgtagaacgtaaactacaaaacggtactggtcggaacctggacctaccgtattcttacgtacctttccg

SEQ ID NO: 331439 - DNA, 544 bp, Homo sapiens
  misc_feature: GZ8MTXP02FFCPD.17.57.F02.1.454.CMB.2.raw
  modified_base (224)..(224): a, c, t, g, unknown or other
  misc_feature (224)..(224): n is a, c, g, or t
tcagcgtagactagcacgaccggtgctcgatttagctcgatatagttggggtttggggggagtcagtctcagtcaggacacagcatggacatgagggtcccccgctcagctcctggggctcctgctactctggctccgaggtgccagatgtgacatccagatgacccagtctccatcctcctgtctgcatctgtaggagacagagtcaccatctcttgccgggnaagtcagagcattagctaacttttaaatggtatcagacggaacagggaaacgcccctaaatcctgatctatactgcatccaatttgacaaaggtcggggccagtactaaggttcagtgcagtggatcgtgggacagtatttcactctcaccatcagcagtctgcaacgtgaggtattttgactaaacttacgtactgtacaaacgagggttaccacggttaccccgtaactacgtttcggaccgtacgggggaaccaaaggtctagggacgaataccaaaacgtaaccgtgtacggctcgaccactatctgtcctttacg

SEQ ID NO: 331440 - DNA, 768 bp, Homo sapiens
  misc_feature: GZ8MTXP02I22JC.17.57.F02.1.454.CMB.2.raw
  modified_base (198)..(198): a, c, t, g, unknown or other
  misc_feature (198)..(198): n is a, c, g, or t
tcagcgtagactagcacgaccggtgctcgatttagctcgatatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagganacagacgtcaccatctcttggccgggacaagtcagagctaattagacttaaactttttaaatggtaatcgacggacggaaccgacgggaaacacccctaaactcctagactctatactgactactactaatttcgactaaagggttcggggtaccctaagtacgtaacgggttccgaaggtcggacgtaggtcgggaactttccggggtagggggtaaacctaagggttacctttttacccgaacctttccaccctaaacccgtacttaccgaacgactaacggttccctacggtaaccctaaacgttaggtaaacgggtttaactttttccgaaaaccgtttaaaacccttttacctaaacggtttacggttaaacccgtaaaacgggtttaaacggggtttaacccctaaacccgggtttaacccccgttaaccgttacggttttaccgggaccggaacggggtaaaccctaggggttacctaggggaaacgtaacttaaacgaaaaccggtaagttcggaacggccttggaaccctacccgttatccccgttagtttactttacccg

SEQ ID NO: 331441 - DNA, 562 bp, Homo sapiens
  misc_feature: GZ8MTXP02GHUXX.17.57.F02.1.454.CMB.2.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccactccctcctgtctgcatctggtaggagacagactcactatctcgttcggccgganagtcagngactaagttagacttaattttaagtgtancgaggaccggaacgaggaaaccaccctaacnctgatcatacnactactacctagtcacgacggtcggaccatacgagtnaggtcgcaggtgctcgtaggactgttactcgactcacacctacgtcagtctacggtcctacgaccgtagtaccgttagttactttcaacgttactttacacgtacgtacgaaacgttcgtacctaccgtacctcgtacgttcgaccgtaaggaccagcggtaagacgtaacaaacgtacgacgtgtcggtactccggactaactcgtcgtttac

SEQ ID NO: 331442 - DNA, 659 bp, Homo sapiens
  misc_feature: GZ8MTXP02JUSIS.17.57.F02.1.454.CMB.2.raw
  modified_base (237)..(237): a, c, t, g, unknown or other
  misc_feature (237)..(237): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagcgtagactagcacgaccggtgctcgatttagctcgatatagttgggtttgggggcaggagtcagtctcagtcaggacacagcatggacatggacgggtccccgctcagctcctggggctcctgctactctggctccgaggtgccagatgtgacatccagatgaccccagtctccatcctccctgtctgcatctgtaggagacagtacgtccaccatcctcgttggcccggganaagtcgagagctattagacttaaacttttaaagtaggtatcgacggaccgggaaaccgaagggaaaccgacccctaaactcctagtatactatactgtactatacctaagtttcgacgtaaggtcgggtaccagtaccgtagtcaggtgcgagtggatcgnggganagtattcactctacactatacacgtcgtacgtctacggtactaacgtagtaggttagtttacaaacgttaccttaacgttacgttagttaaccgtaacggttaacgggtttaaccgtaacccggttaccccgtaacgttaccggtttcggaaccggtaacgggtaccgaacggtacgtacggtaacgtaactaaaccgtaaacgtacgtaacggtacggaacttacggaacctaaccgtttacgttacccgttacg

SEQ ID NO: 331443 - DNA, 586 bp, Homo sapiens
  misc_feature: GZ8MTXP02J42A0.17.57.F02.1.454.CMB.2.raw
  modified_base (144)..(144): a, c, t, g, unknown or other
  misc_feature (144)..(144): n is a, c, g, or t
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtnccagatgtgacatccagatgacccagtctccgatcctcctgtactgcatctgtagganacagatcacctntctcttgacggcaagtcaganctattagctaaactttatagtacncgagcggaacctacggaacgccctaactactnactacattacgatcactacgttattcgataacgcgggtccactgtaacgtcagtcgacgttgngggtaatgtacgggacatctttcaacctctacaccctntacgggacttnacggtcttgaccctagtacgagttcttataccaactacttacgggacttacaaggtaccgcggttactaaacccggtccttaagttcggtacggacccggaaggaccgaaactttgggacgacgttactaaaacccggactttaagggccgttagggtcaaaacccaccctttacacctttcg

SEQ ID NO: 331444 - DNA, 656 bp, Homo sapiens
  misc_feature: GZ8MTXP02FLJ36.17.57.F02.1.454.CMB.2.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (393)..(393): a, c, t, g, unknown or other
  misc_feature (393)..(393): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtcctccatccctccctgtctgcatctggtaagganacagngtccaccatctctgccgggnaaagtcagagctattagacttaaactttttaaatggtatcgaaggaccggaaaccgaagggaaaccaccccttaaactcctagacttctaatacctgacctacttccctaaagtttcgaacgtaaaggtcgggtaccctagtacgtaacgttacgagtcgganaggtgacgtcgtaggactagtatttacactcacaccgtatacgaagtccctaagtcgtacgaccgtaccgtaggtaggttaacttttacggaacctttaaaacgttccttaaacttcgggtaacctaaacggtaacggttacgtaaccgttacccgttaactacgtttcgggaccgtaacggggtacaaacgtcgtacggaacttaacgaaacgtaaacgtacgtaaggttacggaccttagacctaaccttagtctttaacg

SEQ ID NO: 331445 - DNA, 670 bp, Homo sapiens
  misc_feature: GZ8MTXP02JUPKY.17.57.F02.1.454.CMB.2.raw
  modified_base (205)..(205): a, c, t, g, unknown or other
  misc_feature (205)..(205): n is a, c, g, or t
  modified_base (466)..(466): a, c, t, g, unknown or other
  misc_feature (466)..(466): n is a, c, g, or t
  modified_base (494)..(494): a, c, t, g, unknown or other
  misc_feature (494)..(494): n is a, c, g, or t
tcagcgtagactagcacgaccggtgctcgatttagctcgatatagttgggtttgggggcaggagtcagtctcagtcaggacacagcatggacatgagggtccccgctcagctccgtggggctcctgctactctggctccgaggtgccagatgtgacatccagatcgacccagtctccactcctccctgtctgcatctagtagganacagactccacattcgtcttggccggacagtcagagactattacgtacttaaacttttaagttgactcgaggaccggaaccgaaggaacctacccctaaacgtcctagtactactaactacacgactactactagttacgacgtaaggtccgggtacctacgtacgtaacggtcgaagtcgggactacggtggtacgtcggtacggaacgttagttactttaccacgttacctactaccagactacgacgtctaccgtaanaccgtaacgtagtaacgtttacgtttanaaccttaacttacgtactacgtaacgtaaacgttacggtactacccgtacccgttataccgggtttaccgaacgggtacggaacgtacggtaacgtacgggaacttaaccgaaaccggttaaaactacggtaacggttaacccggcttacgaccgtacctaccgttacttacccgg

SEQ ID NO: 331446 - DNA, 715 bp, Homo sapiens
  misc_feature: GZ8MTXP02GB6BL.17.57.F02.1.454.CMB.2.raw
  modified_base (469)..(469): a, c, t, g, unknown or other
  misc_feature (469)..(469): n is a, c, g, or t
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtcctccatccctccctgtctgcatctggtaggagacgagacgtaccacctatccgttcgttcggcccgggacaagtacgagacgactaattacgtacttaaactttttaaagtggtactacggaacggtaccgggaaaccgaacggggaaaccctaccccgtaaactccgtagtactactatacctgctaactacctaagtttcgaacgtaaacggtccgggtaccacgttacgtagtcgaggtcggacgtagtcggactacggtaggactagttacttaccactccgtacaaacctntacgacgtcgtaagtcccgtacgtacgtaaccgttagtaagtttacgtttactaacccgtttaaacttccgtacgttacgtaccgttaaaaccgggttacggttaaacgtaccccgtttaaacccgttacgtaccgggtttacgggaccggtaacgggtaaaccgaggtccggtaaaggaacgtaactaaaccccgtaaggacgttcggacgtacctacgaccgtaccgttacgttcgtttaccgg

SEQ ID NO: 331447 - DNA, 674 bp, Homo sapiens
  misc_feature: GZ8MTXP02JTQ1V.17.57.F02.1.454.CMB.2.raw
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
tcagcgtagactagcacgaccggtgctcgatttagctcgatatagttgggtttgggggcaggagtcagtctcagtcaggacacagcatggacatggacgggtccccgctcagctccgtggggctcctgctactctggctccgaggtgccagatgtgacatccagatcgacccagtctccatccctcctgtctgctatctaggtaggagaacagacgtaccacctattccgttcgttacgggcccgggtaacaacggtcaaggaacgtactaagttaaggactttaaacttttttaaagttagggtattaccgaacggaaccggggaaaccgaaacggggtaaaaccctaccccttaaactccgtagtaactaccttaataccgtactactacgtacctaagtttcgaaaccgtaagggtcgggtaccacgtacgtaaggttcgaaggtcgtagngtcggntcgtacgggaactagtacttacgcctactacacctntacganaccgtgtaccacgaccgtaacgtagtacgttacgttcaaaccttacgttactagtacgtaacgagtaccgggttacaccgttacgcgtttaacgtcggaccgtaacgggactaggacgttaggaaacgtactaaacgacggattcggacttgacgtactcgtactcgttaac

SEQ ID NO: 331448 - DNA, 682 bp, Homo sapiens
  misc_feature: GZ8MTXP02IILXX.17.57.F02.1.454.CMB.2.raw
tcagcgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatcgacccagtctccactcctccctgtctgcatctgtaggagacagatcactatctcgtcgccggacaagtcagagctagttaacgacttaaactttttaaagttggtaactacgaacggaccgggaaaaccgaacgggaaaaccgtacccccttaaaactccgtagtaactactaactactgacctaatacctaaatttcgacgtaaaggtcggggtaccaacgtacgtaagttcgacgtgtacgaaggtggacttacgtagggacctaagttcttacaccttacctacgaaccgtatcgaacgcgttaagtaccgttcgaaccgtaaccgttagaacggtttattttacgaaacgttaacctttactacgtcgtaaaccaagggtaacggtttaaccaacggttaccccttacgttacggtttaccggaacccggtaacggggtaaccaaggtaccgtaaggaacgtacctaaaacgtaaaacgcgtaagtccggactacggcctaactacttacttcg

SEQ ID NO: 331449 - DNA, 685 bp, Homo sapiens
  misc_feature: GZ8MTXP02FHX8O.17.57.F02.1.454.CMB.2.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
tcagcgtagactagcacgaccggtgctcgatttagctcgatatagttggggtttgggggcaggagtcagtctcagtcaggacacagcatggacatgagggtccccgctcagctcctggggctcctgctactctggctccgaggtgccagatgtgacatccagatcgacccagtcctccatcctccctgtctgcatctggtagganacagagtcaccatctctggccgganaagtcagagcatagactaacttttaaattggtatacgaggacggaaccgaacgggaaacgaccccgtaaactcctagactactactactcgactactacctaatttacgacaaacggtcggggtacctactacgtaacggttacgaggtcggacgtaggtggtagtaccccccggtagggtacgtacgtactttacacttacctacctacctataccagactacgtcgtacgacctaaacccgtagtaggttaagtttacgtaacttaaccctttaactaacttacggtaactaaaccggtaacggttaaccgtaaccggttaaaccccgtaaccgttaccgtttaccggtaacccggtaacggggaacccgtaacgtacggttacggaacgtaacgtaaaccgaaaaccgtacgtaacggtacggtctacgaaccgaccgtaactacctttacg

SEQ ID NO: 331450 - DNA, 640 bp, Homo sapiens
  misc_feature: GZ8MTXP02JC7KF.17.57.F02.1.454.CMB.2.raw
  modified_base (206)..(206): a, c, t, g, unknown or other
  misc_feature (206)..(206): n is a, c, g, or t
  modified_base (461)..(461): a, c, t, g, unknown or other
  misc_feature (461)..(461): n is a, c, g, or t
tcagcgtagactagcacgaccggtgctcgatttagctcgatatagttgggtttggggggagtcagtctcagtcaggacacagcatggacatgagggtccccgctcagctccgtggggctcctgctactctggctccgaggtgccagatgtgacatccagatcgacccagtcctccattccctccctgtctgctatcgtggtagganacgagacgtccaacctattctcgttggccgggacaaacgtcagagactaattacgtacttaaacgttttaaagtgtatacgacggtaccgggaaaccgaacggaaaccgacccctaaactcctagtacttacctatacgttacactactactaacgtttacgaacgtaaacggtcgggtacccagtaccgtaaggtacaggtcgacgtaggtacgattcgaggactagtacttacactctacaacctataccagntacgtacacactaactggtaacgttagttacgactaaactacttaacgtcgtaacgtaccgtaaacggtacccgtaaccgtacccgtagttacgttcggaacgtacggactaaacgtgtaaggacgaataaacgaactacggcgttacgaactacgactacgagttctacgttacctcg

SEQ ID NO: 331451 - DNA, 584 bp, Homo sapiens
  misc_feature: GZ8MTXP02H45U2.17.57.F02.1.454.CMB.2.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (570)..(570): a, c, t, g, unknown or other
  misc_feature (570)..(570): n is a, c, g, or t
tcagcgtagactagcacgaccggtgctcgatttagctcgatatagttgggtttgggggagtcagtctcagtcaggacacagcatggacatgagggtccccgctcagctcctggggctcctgctactctggctccgaggtgccagatgtgacatccagactgacccagtctccatcctcctgtctgcatctgtagganacagagtcacatctcttggcggcaagtcagagctagtanctaatttaaatgtancagcggaactagggaactacccctaaatcagatctagctagctactaccgaatttcgaactaaaggtcgggccctagtcgaacgttcaaggtcgaatggtagtaagtccgtaaaggggtacaacggtttcttaaccctactccaaccgaacccttcgaatacgtacgtacgtaccgtacgtaacgtaacgtagtacgttacgtttacgtactaacttactacgtagtactaacgtacgtacgtaccgtacccgtacgtaccgttacgtacgacgacgtacgacgtacgacgactacgaacgacgtagtacgtcgacacnctctctacgtactc

SEQ ID NO: 331452 - DNA, 585 bp, Homo sapiens
  misc_feature: GZ8MTXP01DXGFB.17.39.D06.1.454.CMB.2.raw
  modified_base (204)..(204): a, c, t, g, unknown or other
  misc_feature (204)..(204): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagagtgttggcagcaaacttagcctggtatcagcagaaacctggccaggctcccaggcctcctcatgtatggtgcatctacgagggccacgtggtctcccagcctaggttcagtggacaggtggggtctggggacagtagttctctctcatcatcagcagcctgcagtctagtaaagtgtttttgggcggtttttaattacctgttcagtctaagttaataaagtcgaagttcggcccttccgggtggaacccggtttcgggacccgaaaagggggcccgttaaaaggggttacgggaaaaacttaaccggaaaaaccggtaacgttgggtacgggaccttggaacccgtaacccg

SEQ ID NO: 331453 - DNA, 505 bp, Homo sapiens
  misc_feature: GZ8MTXP01BUDM9.17.39.D06.1.454.CMB.2.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (373)..(373): a, c, t, g, unknown or other
  misc_feature (373)..(373): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttggcagcaacttagcctggtatcagcagaacctggccaggctcccaggctcctnatgtatggtgcatcctaccgagggcccacgtggtcgtccccagcccaggttcaggtggcaggtgggtctggggacaggtgttcnctctcatcatcagcagcctgcagtctagagtatttgggcggttttatctgtcagctagtataatcagtcggcctcggtggacgttcggacgaaggggacagggttggaaactcaaacgctggtggctgcaac

SEQ ID NO: 331454 - DNA, 521 bp, Homo sapiens
  misc_feature: GZ8MTXP01DN5KP.17.39.D06.1.454.CMB.2.raw
  modified_base (209)..(209): a, c, t, g, unknown or other
  misc_feature (209)..(209): n is a, c, g, or t
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (409)..(409): a, c, t, g, unknown or other
  misc_feature (409)..(409): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanagccaccctctcctgcagggccagtcagagtgttggcagcaacttagcctggtatcagcaagaacctggccaggctcccaggctctcatgtatggtnctatctaccgagggccagtggtctcccagccaggttcagtggacaggtggggctggggactagcgttctctctnatcatcagcagcctgcagtcagtaagttnttttgggcggttttatacgtgtcagctagtataatgagtcgcctcggtggacgtcggacgaaagggacaagggttgaaactaacgaaaacgtaactggtacggctgctaacc

SEQ ID NO: 331455 - DNA, 505 bp, Homo sapiens
  misc_feature: GZ8MTXP01DJUWO.17.39.D06.1.454.CMB.2.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagagtgttggcagcaacttagcctggtatcagcagaacctggccaggctcccaggctcctcatgtatggtncatctaccgagggccatggtctcccagccaggttcagtggcaggtgggtctggggacagtagttctctctcatcatcagcagcctgcagtctagagtattttgggcgttttattactgtcagcagtataatcagtcgcctcgtggacgttcggacgtaagggaccaaggttggaaactcgaaaacgtcgtggtggctcgctaacc

SEQ ID NO: 331456 - DNA, 502 bp, Homo sapiens
  misc_feature: GZ8MTXP01DTJ0W.17.39.D06.1.454.CMB.2.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagagtgttggcagcaaacttgcctggtatcagcagaacctggaccaggctcccaggctcctnatgtatggtncatctacagggccacgtggctcccagccaggttcagtggcaggtgggctgggacagngttcntctcatcatcagcagcctgcagtcgtgaaagtnttttggggacgttttatactgtcagctagtatatcgagtcggcctcggtggacgttcggacaaaggggccaaagggttgaaactcgaaaagctggagctgcctaac

SEQ ID NO: 331457 - DNA, 518 bp, Homo sapiens
  misc_feature: GZ8MTXP01B2L85.17.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccagggggaaangccaccctntcctgcagggccagtcagngtgtggcagcaacttgcctggtancagcagaactggccaggctccaggctcctcatgtatggtgcatctaccgaggggccacgtggtcgtcccagcccaggttcaggtggacagggtgggtctggggacaggtacgtttctctctcatcatcagcagcctgcagtctgaacgttnttttggggcggttttatactgtcagntagtatatcagtcggctcggtggacgtcgacgaagggtaccaagggttgaaactcgaaacgtaacgtggacggctcggctaaccg

SEQ ID NO: 331458 - DNA, 533 bp, Homo sapiens
  misc_feature: GZ8MTXP01CN4Q0.17.39.D06.1.454.CMB.2.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (424)..(424): a, c, t, g, unknown or other
  misc_feature (424)..(424): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttggcagcaacttagcctggtatcagcagaacctggccaggctcccaggcctctcatgtatggtncatctaccgaggggcccacgtggtcgtccccaggtcccaggtttcaggtcgggactagggtggggtctagggggactaggtacgttctcgtctcatccgatcagcagcctgctagtctagaagtnttttggggacgttttatactgtcagtctagttataatcaggtcgcctcgtggacgttcggcgtaaaggggcaagggttcgaaatcgaaaagtctggtggctggctaacc

SEQ ID NO: 331459 - DNA, 545 bp, Homo sapiens
  misc_feature: GZ8MTXP01C4TO7.17.39.D06.1.454.CMB.2.raw
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (415)..(415): a, c, t, g, unknown or other
  misc_feature (415)..(415): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaangccaccctctcctgcagggccagtcagagtgtggnagcaacttgctgtatcagcagaacctggaccaggcctcccaggcctcctnatgtatggtncatcctaccgagggcctacgtggtcgtccccagccctaggttcagtggctagggtcgggtctggggacaggtcgttctcgtctcatcatcagcagctgcagtctagtaagttnttttgggcggttttatacgttgtctaagtctagtaataatcgtaggtcggccgttcggtggaccggttcggaccgaaagggaccgttaagggttcgaaataaccgaaaagtaacgtggtgctgcctaacg

SEQ ID NO: 331460 - DNA, 600 bp, Homo sapiens
  misc_feature: GZ8MTXP01BA7RH.17.39.D06.1.454.CMB.2.raw
  modified_base (210)..(210): a, c, t, g, unknown or other
  misc_feature (210)..(210): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaagggggaaangcccaccctctcctgcagggccagtcagagtgtggcagcaacttgcctggtatcagcagaacctggccaggctcccaggcctctcatgtatggtagctatcctaaccgagggtccctagtcggtcgtccccgagcccgtaggttccaggtcggcgtagggttggggtacgtggggacaggtacgtttctcttctcatcatcagcacgtcctgcctaggtctaggtaaagttgttttcggggtcggttttaattacgtgtacagtctaagtaatactgagttcggcctcggtacggacggttccgggacgaaacggggtaaccgttaagggttaggttaaaaccgttaacgaaaaacccgtcgtggttacgggccgttcgaacgtaacccg

SEQ ID NO: 331461 - DNA, 538 bp, Homo sapiens
  misc_feature: GZ8MTXP01B2M7A.17.39.D06.1.454.CMB.2.raw
  modified_base (210)..(210): a, c, t, g, unknown or other
  misc_feature (210)..(210): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagcgtagactagcacgaccggtgctcgatttagtgacatctcgcagttcgtttggggggggaggaactgctcagttaggacccagacggaaccatggaagccccagcgcagcttctcttcctcctgctactctggctccagataccactggagaagtagtgatgacgcagtctccagccacctgtctgtgtctaccgaagggggaaancgccacctctcctgcagggccagtcagagtgtggcagcaacttgctggtancagcaagaacctggccaggcctcccagctcctnatgatggtncatcacgnggccagtggctccagcctaggtcaggtggacagggtggtctggggacaggtcttcnctctnatnatcagcacgctgctagtctagaagttntttgggtacgttttatactgtanagtctaagtaatagtcgtaggtccgtccgtcggtgggttaccggtcggaaccgtaaagggtaacgttaaagggttacgaaactaacgaaacgtcgtaggcgactcgaactaac

SEQ ID NO: 331462 - DNA, 561 bp, Homo sapiens
  misc_feature: GZ8MTXP01AESY7.17.39.D06.1.454.CMB.2.raw
  modified_base (208)..(208): a, c, t, g, unknown or other
  misc_feature (208)..(208): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
  modified_base (478)..(478): a, c, t, g, unknown or other
  misc_feature (478)..(478): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgtggcagcaacttgcctggtatcagcagaacctggccaggctccagacctcncatgtatggtncatcctaccgagggccagtggtctcccagccgtaggttcaggtcggactagggttggggtctgggggactaggtacgtttcnctctcatcatcagctagcctggctagttctagaagttntttggggcgtttatactggtacngtctaagtataatcgtaaggtcgcccgttcggngggttaccggttcgggaccgtaaaggggaccgttaagggttacggaaactaaccggaaagtaacgtggtcggactcgctaacg

SEQ ID NO: 331463 - DNA, 498 bp, Homo sapiens
  misc_feature: GZ8MTXP01B2RGH.17.39.D06.1.454.CMB.2.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (373)..(373): a, c, t, g, unknown or other
  misc_feature (373)..(373): n is a, c, g, or t
  modified_base (474)..(474): a, c, t, g, unknown or other
  misc_feature (474)..(474): n is a, c, g, or t
  modified_base (490)..(490): a, c, t, g, unknown or other
  misc_feature (490)..(490): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtggcagcaaacttgcctggtatcagcaagaacctggccaggctccagctctnatgtatggtncatcctacgagggccagtggtctcccagccaggttcaggtggcaggtggggtctggggacctaggtacgttcnctctcatcatcagcagcctgcagtctagaagttattttgggcgttttattactgtacagtcagtatatcagtgctcggtgacgtcgcgtaaggacaggttnaaatcaaagaactggngctgcaac

SEQ ID NO: 331464 - DNA, 633 bp, Homo sapiens
  misc_feature: GZ8MTXP01DT5YM.17.39.D06.1.454.CMB.2.raw
  modified_base (209)..(209): a, c, t, g, unknown or other
  misc_feature (209)..(209): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgccaccctctcctgcagggccagtcagagtgttggcagcaactgcctggtatcagcagaacctggaccaggcctcccgaggcctcctcatgtatggtgctactcctaaccgagggcctaacgtcggtcgtccccagccgtaggttcgaggtcggacgtagggtcggggtctaggggactaggtacgttcttctctcatcatcagcacgtcctgcagttctagtaagttagtttttacggggtacggtttttattaccgttagtactaaggtctaagttaaattaagtcgtaggttccggtccgttaaccgggtgggttaccggtttcgggaaccgtaaagggggtaaccgttaaaggggttacggaaaacgtaaccgtaaaaaccggtaagttcggtacgggttcttaacggaaccttaaccg

SEQ ID NO: 331465 - DNA, 668 bp, Homo sapiens
  misc_feature: GZ8MTXP01CHJSW.17.39.D06.1.454.CMB.2.raw
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcagggccagtcagagtgttggcagcaacttagcctggtatcagcagaacctggccaggctcccgaggctcctnatgtatggtncatctacgngggccacgtggtcgtccaccgccgtaggtcgaggtggcgtaggtcgggtcgtagggactagtacgttctctctctatcgatcgagcacgtccgtgacgtacgttcgtaagtaagtttagtttttacggggtacggttttttaattaccgttcggtaccgtagtacgtaaagtttaacgtaaacgtcggtaacggttcccgggtacccgtttcccgggggttacgggttacccggggtttaacccgggaccggtaaaaacgggggtaacccgttaaaagggggtttaacggaaaaccgttaaccggaaaaacgtaaccggttagggttacggacccgttcggaacccgtaacccg

SEQ ID NO: 331466 - DNA, 606 bp, Homo sapiens
  misc_feature: GZ8MTXP01EFKRN.17.39.D06.1.454.CMB.2.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctcagccaccctgtctgtgtctccgaggggaangccaccctntcctgcagggccagtcagagtgttggcagctaattgcctggtatcagcaagaaacctggaccaggctcccgaggcctcctcatgtatggtnctatcctaccgngggccagtggtctcccagccaggtcagtggacaggtgggtctgggacaggtacgttctcgtctcattcatcagcagtcctggcctaggtctagtaagttgttttcggggtacggttttattacgtgtacaagtctaagttaataacgtcgaaggttcggcccttaacgggtcggttaccggttacgggaccgtaaacggggtaacccgttaaaggggttacggaaaaacttaacggtaaaaccggtaacgtttgggacgggttacttaaccgggaaccgttaaacccg

SEQ ID NO: 331467 - DNA, 572 bp, Homo sapiens
  misc_feature: GZ8MTXP01C07VU.17.39.D06.1.454.CMB.2.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (416)..(416): a, c, t, g, unknown or other
  misc_feature (416)..(416): n is a, c, g, or t
  modified_base (551)..(551): a, c, t, g, unknown or other
  misc_feature (551)..(551): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccacctctcctgcagggccagtcagagtgttggcagcaacttagcctggtatcagcaagaacctggccagggcctcccgaggcctcctcatgtatggtncatcctaccgagggccacgtggtcgtcccagcccaggttcaggtggacaggtggggtctggggacaggtcgttctctctcatcatcagcagtcctgctagtctaggtaagttnttttggggtcggttttatacttggtacagtgtagtaataactcgaggtcggaccttcgggtgggttaccggttccgggaaccgtaaagggcccttaaaaggggttcgaaaacgttcccgaaaagtcgttacgggnggaccttaaggcccgtaaccg

SEQ ID NO: 331468 - DNA, 686 bp, Homo sapiens
  misc_feature: GZ8MTXP01EL7IQ.17.39.D06.1.454.CMB.2.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (393)..(393): a, c, t, g, unknown or other
  misc_feature (393)..(393): n is a, c, g, or t
tcagcgtagactagcacgaccggtgctcgatttagtgacatctcgcagttcgtttgggggggggaggaactgctcagttaggacccagacggaaccatggaagccccagcgcagcttctcttcctcctgctactctggctcccagataccatggagaagtagtgatgacgcagtctccagccaccctgtctgtgtctccgaaggggaaancgcccaccctctcctgcagggccagtcagngtgtgcagcaacttgctggancagcagaacctggccaggctccaggctctnatgtatggtncatccaccgngggccacgtggtcgtcccacgccgtaggttcaggtcgggactagggtggggtcctagggggacctaggtacgtttctctctnaatcaatcacgtcacgcctagccgtagtcgtaaggtaaagtttgttttacggggttacgggtttttaactttaccgtagtttaccgaagttccgttaaaggtttaaataacgttacgttaaccgggttccgggggtccccgtttaaccggggttaacgggttaccccgggtttacgggaacccgggaaaacggggtaaaccccgggttaaaggggttaaacggaaaaacgtttaacccggaaaaacgtaaccgggttgggttcggggacctttaaccgggaaccgttaacccg

SEQ ID NO: 331469 - DNA, 624 bp, Homo sapiens
  misc_feature: GZ8MTXP01B6STX.17.39.D06.1.454.CMB.2.raw
tcagcgtagactagcacgaccggtgctcgatttagtgacatctcgcagttctttggggtctgggagaggagcccagcactagaagtcggcggtgtttccattcggtgatcagctctgagcacagaggactcaccatggagtttgggctgagctgggttttcctcgtcgctcttttcagaggtgtccagtgtcaggtgcagctggtggagtcgtgggggagcgtggtccagcctggggagtccctgagactctcctgtgcagcgtctggattcgaccttcagtaactagtggcatcgcacgtcgggtcccgccagggcctccgagggccgaagggggctggggaggtggggtggctaggtttagtggttagggtatggagttagggaaagttaactacgaaattactaagttagtaagtacctccggtaggaacggggtccgtaactttccgacctagtaccctacccgaagaacgaacctaaacgttaccgaaagaaccacggtcctagtactctagactaaaagtcgaaactagaacctagacggacgttcggaaacggaccgttacgggacttggttaacgtacgttaacgtggtcggacggtaaggttaacgggtttccgg

SEQ ID NO: 331470 - DNA, 548 bp, Homo sapiens
  misc_feature: GZ8MTXP01A7RUR.17.39.D06.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaangccaccctctcctgcagggccagtcagngtgtggcagcaacttgcctggtatcagcagaaacctggaccaggcctcccgaggcctcctcatgtatggtgcatcctaccgagggccagtggtctcccagcctaggttcaggtcgcagggtgggtcnggggacnggtacgttcnctctcatcatcagcagcctgctagtctagtaagttagttttcggggtacgttttattacctggtaccagtctaagttaactatcgtagtcggccctcgggtggttaccggttcggaccgaaagggtacaagggttgaaactcgaaacggctgggcgactggccaacg

SEQ ID NO: 331471 - DNA, 541 bp, Homo sapiens
  misc_feature: GZ8MTXP01CGZQ6.17.39.D06.1.454.CMB.2.raw
  modified_base (382)..(382): a, c, t, g, unknown or other
  misc_feature (382)..(382): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcaagaacctggccaggcctcccaggctcctcatgtatggtgcatctaccgaggggcccagtggtcgtccccagccaggttcagtggacagtgggtctaggggacagtgttctctctnatcatcagcagcctgcagtctagaagttnttttggcggttttatacngtcagctagttaacatcgagtcgcctcggtggttacggttccggaccgaaaggggtccttaaaggggttggaaaacttaacgaaaacgcgttgggcgacgtaacgctaaccg

SEQ ID NO: 331472 - DNA, 581 bp, Homo sapiens
  misc_feature: GZ8MTXP01B7X0Y.17.39.D06.1.454.CMB.2.raw
  modified_base (204)..(204): a, c, t, g, unknown or other
  misc_feature (204)..(204): n is a, c, g, or t
  modified_base (483)..(483): a, c, t, g, unknown or other
  misc_feature (483)..(483): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttggcagcaacttgctggtatcagcagaacctggccaggcctcccaggcctcctcatgtatggtgcatcctacgagggccagtggtctccccagccgtaggttcagtggactagggtggggtctaggggactaggtacgtttctcgtctctatcatcagcaggtcctagcgagtctagaagttattttgggacggttttattacgtgtacagtactagttaatagtcgtagtcggcccgttcgggnggttaccggttcggacggtaaacggggccgttaaaggggttaacggaaaacttaacggaaaaaccggtcttgggacgggttactaacgccgttaaccg

SEQ ID NO: 331473 - DNA, 635 bp, Homo sapiens
  misc_feature: GZ8MTXP01ASJY0.17.39.D06.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (618)..(618): a, c, t, g, unknown or other
  misc_feature (618)..(618): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccacctctcctgcagggccagtcagngtgtgcagcaacttgcctggtatcagcaagaacctggccaggcctcccgaggcctcctcatgtatggtgcatcctaccgagggcctacgtgtccgtaccgccgtcgtaggtcaggtcggacgagggttgggcgtacgggaactaggtcgttccgtctactctacttcagtcacgcgtacgtccgtgtaccgtagttacgtagttaaagtttggttttacgggttacggttttattacgtgtacgaggtctaaagtaagttacgtcgtagggtccgtccggttccggggtacggttaccgggttaccggaaccgggtaaacggggtaaccggttaagggttaacggttaaaacgtaaccggtaaaacgtcgtacgggtacggntaaccggaacctaaccg

SEQ ID NO: 331474 - DNA, 582 bp, Homo sapiens
  misc_feature: GZ8MTXP01BDRO4.17.39.D06.1.454.CMB.2.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (298)..(298): a, c, t, g, unknown or other
  misc_feature (298)..(298): n is a, c, g, or t
  modified_base (389)..(389): a, c, t, g, unknown or other
  misc_feature (389)..(389): n is a, c, g, or t
  modified_base (570)..(570): a, c, t, g, unknown or other
  misc_feature (570)..(570): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagngtgtggcagcaacttagcctggtatcagcagaacctggccaggctccaggcctctcatgtatggtncatcctaccgaggggccacgtggtcgtcccccaggcccgtagggttccaggtcggacgtagggtggggtctgggggactaggtacgtttcncgtctcatcatcagcacgtcctgcaagttctagtaagttatttggggtacggttttattaccgtgttaccagtctaagttataacgtcgaggtcgtcccgtcggtggaccggttcgggacgtaaacggggaaccgttaaggggttacgaaaacgtcgaaaacggtctgggtacggttaccngaaccgtaaccg

SEQ ID NO: 331475 - DNA, 582 bp, Homo sapiens
  misc_feature: GZ8MTXP01BV7AM.17.39.D06.1.454.CMB.2.raw
  modified_base (234)..(234): a, c, t, g, unknown or other
  misc_feature (234)..(234): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (432)..(432): a, c, t, g, unknown or other
  misc_feature (432)..(432): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagngtgttggcagcaactgcctggtatcagcaagaacctggccaggcctcccaggctcctnatgtatggtncatccgtaccgagggccctacgtggtcgtcccgagcctaggttcgaggtggacgagggtcggggtcgtaggggacctaggtacgtttctcgtctcatcatcgagcacgtccctgctagtctagtaagttnttttggggtacgttttatacgtgtcagtcgtaagtataagtcgaggttcgtccgtccggtgggttccggttacggaccgtaaacggggaaccgttaagggttacggaaactaacgaaaacgtaacgtgggtacgcgtcgaaccgtaaccg

SEQ ID NO: 331476 - DNA, 673 bp, Homo sapiens
  misc_feature: GZ8MTXP01DYMSQ.17.39.D06.1.454.CMB.2.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (404)..(404): a, c, t, g, unknown or other
  misc_feature (404)..(404): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcgagggccagtcagagtgtgcagctaatgctgtatcagcagaacctggaccaggcctccgagtctcctcntgtagtggttgacacgtccctaccgacggggccctacgtggtccgtcccgacgcccgtaggttcgaggtggacgtagggtcggggtacgtgggacctagtcgttctcttacctntaactcaacgtcgacggactacggtccttaggaccgtaggttacgtaggtaaaacgttttcggtttttaagggggttacggtttttaacctttaagtttccggtaacgtaacgttacgttaagttaacttacgtcggtacggttccggtacccggttccgggtacgggttacccgggtaccgggaaccggtaaacggggtaacgttaaagggttaacggaaacgtaaccgaaaacggtcgtcggtacggttacgtaacgaaccgtaacg

SEQ ID NO: 331477 - DNA, 669 bp, Homo sapiens
  misc_feature: GZ8MTXP01BKESN.17.39.D06.1.454.CMB.2.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctcgaggggaancgccaccctctcctgcaggccagtcagngtgtgcagcaattgctggtancagcagaacctggccaggctcccagcctcntntgtatggtnctatccgtacgngggcctacgtggtcgtcccgagtccgtaggttcgaggtcggacgtagggttcggggtcgtagggggacctaggtacgtttcctcgttactactaattccatacgaacgcccgtaaggtcccttgggacctagttccgtaaggtaaacgttttcgttttttagggggtacggtttttttaaacttaccgttgttaccgaaggtacttaaagttaacgttaactccgggtaaggttccggccccgtttcgggtacgggttaccggttaccgggaaaccgaaacgggggtaaccgttaaaggggttaacgaaaacgttaaccggaaaaccgttcggttgggcgttaccgttaacggaaccttaacccg

SEQ ID NO: 331478 - DNA, 630 bp, Homo sapiens
  misc_feature: GZ8MTXP01CV0RB.17.39.D06.1.454.CMB.2.raw
  modified_base (204)..(204): a, c, t, g, unknown or other
  misc_feature (204)..(204): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttggcagcaacttagcctggtatcagcagaaacctggccaggcctccccgaggcctcctcattgtagtggtgctatccctaaccgaggggccctacgttggtcgtcccccgacggtcccgtaggttcgaggtcggaccgtagggtcggggtcgtggggacctaggtacgttcctctctcatcatcagcacgcctgcagttctagtaagttgttttggggacggttttattacgtgttcagtactagttaactacgtcgacggtcggcccgttcgggtacgggttaccggttaccgggaccgtaaacgggggtaacccttaaaggggttcgggaaaacttaacccggtaaaaacggtaacggttcgggtacgggccttcgggaaccgtaacccg

SEQ ID NO: 331479 - DNA, 537 bp, Homo sapiens
  misc_feature: GZ8MTXP01EL1S0.17.39.D06.1.454.CMB.2.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccatggagaagtagtgatgacgcagtctccagccaccctgtctgtgtctcgaggggaaancgccaccctntcctgcaggccagtcagngtgtgcagcaactagcctggtatcagcagaaacctggccaggctccgaggtctctcatgtatcggncatctaccgagggccagtcggtgtcccagctaggttcagtggcagtgggtctggggacagtacgtttcnctctntatcatcgagcagccttncngtgtagtagttagtttagggttagtttagttagttgtatagtagtagtaatatacgtacgtcgtcgtcggtcggttcggtacggacgaacggaacgttaaggttacgttaacgtaagaacgtaacgtgtgacgtcgcgtaacg

SEQ ID NO: 331480 - DNA, 591 bp, Homo sapiens
  misc_feature: GZ8MTXP01CMDRC.17.39.D06.1.454.CMB.2.raw
  modified_base (209)..(209): a, c, t, g, unknown or other
  misc_feature (209)..(209): n is a, c, g, or t
  modified_base (310)..(310): a, c, t, g, unknown or other
  misc_feature (310)..(310): n is a, c, g, or t
  modified_base (408)..(408): a, c, t, g, unknown or other
  misc_feature (408)..(408): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaangcccacctctcctgcagggccagtcagagtgtggcagcaacttgcctggtatcagcaagaaacctgggccaggcctcccgaggcctcctcatgtagtggtnactatccgtaaccgagggggtccctacgtggtcgtccccaggtcccgtagggttcaggtcgggactagggtcggggtctaggggactagtacgtttcnctctctatcatcgagcgagtcctgctagttctaggtaagttgttttgggcggtttttaataccgtgtacagtctaagttaataacgtcgaggttcggcccgttcggtgggttccgttcggacggtaaacggggtcgaagggttgaaaactaacgaaacgtaacgtggtaggcctgaactaacg

SEQ ID NO: 331481 - DNA, 665 bp, Homo sapiens
  misc_feature: GZ8MTXP01B7KSA.17.39.D06.1.454.CMB.2.raw
  modified_base (211)..(211): a, c, t, g, unknown or other
  misc_feature (211)..(211): n is a, c, g, or t
tcagcgtagactagcacgaccggtgctcgatttagtgacatctcgcagttcgtttggggggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaancgcccacctctcctgcgagggccagtcagagtgttggcagctaacttgctggtatcagacaagaacctggccgaggcctcccgaggtcctcctcgatgtagtggtgctactccgtaaccgacggggtcccacggttcggtcgtacccccgacggtcccgtaggttccgaggtcggacgtagggttcggggtcgtaggggacctagggtacgtttcgtctctcatcagtcagtcacgtcctgacgtagttcgtaggtaaagtttgtttttaggggacgtttttaattacgtgtacagtctaagtttaatacgtcgtaaggttcggtcccgttcggtgggttacccggttacgggaacccgtaaagggggtaacccgttaaggggttaacggttaaacgtaacggtaaaaacgggtccgtttaggggtcggttaccgtaacggttaacctaacccg

SEQ ID NO: 331482 - DNA, 612 bp, Homo sapiens
  misc_feature: GZ8MTXP01CJQO4.17.39.D06.1.454.CMB.2.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
tcagcgtagactagcacgaccggtgctcgatttagtgacatctcgcagttcgtttggggggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaancgcccaccctctcctgcagggccagtcagngtgtggcagcaacttagctggtatcagcagaacctggccaggctcccgaggcctcctcatgtatggtncatctaccgagggccacgtggtcgtcccacgccgtaggttcaggtggacgtaggtggggtcgtggggactaggtagttctctctcatcatcagcagcctgcagtctagtaagttagttttggggtacggtttttaattccgtggttactaggtactaaggttaattaactcgtaacggttcgggtcccgttccggggttgggttaccggttaccgggaccgggaaacggggtacccgttaaaggggttacggaaaacgttaaccgaaaacggtaaccgtagggtcgggctcggcccgtaaccg

SEQ ID NO: 331483 - DNA, 773 bp, Homo sapiens
  misc_feature: GZ8MTXP01CHAE8.17.39.D06.1.454.CMB.2.raw
  modified_base (201)..(201): a, c, t, g, unknown or other
  misc_feature (201)..(201): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccacctgtctgtgtctcgaggggaancgccacctctcctgcaggccagtcagagtgtggcagcaacttagcctggtatcagacagaacctggccaggcctcccgaggtcctcctcgattcggtagtgggtcgactacgttccgtaacccgacgggggtacccctacgttcggggttaccgttaccccccgaacggtccccggtaggggttttacccgaaggggttcggggaacccgttaagggggtttcgggggttacccgttaggggggaacccttagggttacgtttcccttcgttcctacgtacttcaacgttcaacggcctaacgtcccgtggtaccgtagttccgttaaggttaaggtttacgttttttacggggtaccggttttttaagttaccgtttaggtcgtaaccggtacttaaaggtttaactaaacgttccgtaagggtttcccgggtacccggttaaccgggtacggggttaccggtttacccggggaacggtaaaccgggggtaaccgaaaggggttacgttaaaaccgtaacgtaaaaaccgggtaacggttcgggtacggttccgtcgttaaccgtaacccg

SEQ ID NO: 331484 - DNA, 588 bp, Homo sapiens
  misc_feature: GZ8MTXP01DWDT2.17.39.D06.1.454.CMB.2.raw
  modified_base (208)..(208): a, c, t, g, unknown or other
  misc_feature (208)..(208): n is a, c, g, or t
  modified_base (259)..(260): a, c, t, g, unknown or other
  misc_feature (259)..(260): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgtggcagcaaatgctgtannagcagaactgcaggctccagctcnatgatggnctatctacgngggctacgtggctcccagccgtaggttcaggtcggccgtagggttcgggggtactagggggaactaacggttacgtttccctcgttctactacttactactccgaagctacggccttagcctagtactggtaaacgttgtttttggggtaccggtttttaaatcctagtcagtactagttaaactatccgtagtccgtccgtcggttggcggttaccgacgaaaggggtaccaaagggttcgaaaactaacgaaaacggtaacgtggtggacctgttaactaaccg

SEQ ID NO: 331485 - DNA, 580 bp, Homo sapiens
  misc_feature: GZ8MTXP01DHD6L.17.39.D06.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaangccacctctcctgcagggccagtcagagtgtggcagcaacttagcctggtatcagacaagaacctggccaggcctcccgaggtcctcctnatgtacgtggtgctatcgtaccgagggcctacgtggtcgtcccagccgtaggttcgaggtggactaggtggggtctaggggactaggtcgtttctctctcatcatcgagtcagcctgctagtctaggaagttagtttcgggtacgttttattacgtgtacagtctaagttaatactcgtacgttccggcccttaaccgggttggttaccggttcggaaccgtaaagggaaccgttaagggttacgaaaacgtaacgaaaacgtcgtggtagttccgtaagcctaacg

SEQ ID NO: 331486 - DNA, 566 bp, Homo sapiens
  misc_feature: GZ8MTXP01BP38Q.17.39.D06.1.454.CMB.2.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (381)..(381): a, c, t, g, unknown or other
  misc_feature (381)..(381): n is a, c, g, or t
  modified_base (465)..(465): a, c, t, g, unknown or other
  misc_feature (465)..(465): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtgcagcaactgctggtatcagcagaacctggccaggcctccgaggtctcctcagtgtatggtnctagtcctaccgagggtccagtggtctccagcctaggttcaggtggaactagggtcgggtcgtaggggactaggtacgtttcncttctactatcatcgaggctacggcctgacgtagttcgtagtaaacgtttgttttcgggtacggtttttataccgtgtacagtntaagtatatcgtagtcgtcccgtcggtggttacggttccggacggtaaacggaccgttaagggttacgaaactaacgaaacgtcgtgtacgctcgcctaac

SEQ ID NO: 331487 - DNA, 571 bp, Homo sapiens
  misc_feature: GZ8MTXP01CQ0US.17.39.D06.1.454.CMB.2.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (305)..(305): a, c, t, g, unknown or other
  misc_feature (305)..(305): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagngtgtggcagcaacttgcctggtatcagcaagaacctggccaggctcccgagcctctcatgtatggtncatccgtacgagggccagtggtctcccagccgtaggttcaggtggactagggtcggggtctggggactaggtacgttctctctcatcatcgagcacgtcctgctagttcgtagtaagttagttttggggtacggttttaatcgtgtcgagtactaagttataagtcgtacggtcgtcccgtcgggtggttaccggttccgggacgtaaacggggccgttaagggttacggaaactaacgaaacgtaagtggtagctgaacctaacg

SEQ ID NO: 331488 - DNA, 663 bp, Homo sapiens
  misc_feature: GZ8MTXP01DIVIY.17.39.D06.1.454.CMB.2.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (262)..(263): a, c, t, g, unknown or other
  misc_feature (262)..(263): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
tcagcgtagactagcacgaccggtgctcgatttagtgacatctcgcagttcgtttgggggggggaggaactgctcagttaggacccagacggaaccatggaagccccagcgcagcttctcttcctcctgctactctggctcccagataccactggagaagtagtgatgacgcagtctccagccaccctgtctgtgtctaccgaaggggaaancgcccacctctcctgcagggccagtcagagtgtggnagcacttgctggannagcagaaccngcagctccagctcnatgtatggtnctactcgtaaccgacgggctacgtggtacgcccgtcggaccgtaaggttcaagggttcgggaacgtagggttcgggggtaccgtagggggtaacctaaggtacggtttcctacgtcttacccatccgtaactcgaaagtccgtaaccgtccggttaagcccgttaagtccgtaaggttaaacgttagttttttcgggggtaaccggtttttaattaacccggttgaaccgtaggtaacttaaaggttaaacctttaagcggtaacggttcccggcccgttcggtacgggttaccggttacggaccggaaaggtaccggaaaaggttagaaacgtaacgaaacggtgttggcggactcgaactaacc

SEQ ID NO: 331489 - DNA, 638 bp, Homo sapiens
  misc_feature: GZ8MTXP01AE093.17.39.D06.1.454.CMB.2.raw
  modified_base (203)..(203): a, c, t, g, unknown or other
  misc_feature (203)..(203): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (375)..(375): a, c, t, g, unknown or other
  misc_feature (375)..(375): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccacctgtctgtgtctcgaaggggaaancgccacctctcctgcagggccagtcagtagtgtggcagctaaacttgcctggtatcagcaagaacctggccaggcctccngcctccncatgtntggncatctaccgnggccagtggctccagcctaggttcgagtcggctagggtcgggtcgtggggactagtaccgtttcncgttactctatctatcgaacgcaacggtcctgcgtaacggttcttaaggttaagtttacgttttttagggggtacccgttttttaagttaccgttggtaaccgtagtacgttaaagttacttacgtacgtacgggtccggttcccgttcggggtaaggttcccggggttaccgaaccggaaaacgggtacgggttaaacgggttaaacgaaaacgtaacgtaaaaacggtcgtacgggtcggttaccttcggaaccttaaccg

SEQ ID NO: 331490 - DNA, 589 bp, Homo sapiens
  misc_feature: GZ8MTXP01ARIKZ.17.39.D06.1.454.CMB.2.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccaccctctcctgcagggccagtcagagtgtggcagcaacttgcctggtatcagcagaacctggccaggcctcccaggcctcncatgtatggtncatccgtacgagggccagtggtcgcccgngccgtaggttcgagtggcgtagggtgggtctggggactaggtacgttctcgtctcatcatcgagcagtcctagcctagtctagaagtttagttttggggtacggttttattacgtcggttacagtacgtaagtttaaataacttcggacggttccggcccgttaaccgggtacgggttaccggttccgggacgtaaacggggacgttaaagggttcggttaaagtaaccgaaaacggtgtcggtggctcggaacgtaaccg

SEQ ID NO: 331491 - DNA, 540 bp, Homo sapiens
  misc_feature: GZ8MTXP01C2L68.17.39.D06.1.454.CMB.2.raw
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttggcagcaacttagcctggtatcagcaagaacctggccaggcctcccaggcctcctcatgtatggtgctatcctaccgagggcccacgtggtcgtccccgagcccgtaggtttcaggtcggctagggtggggtctggggacagtgttctctctcatcatcagcagcctgcagttctagtaagtgttttggggtcggttttattacgtgtcagtctagttatatcgagtcgccgtcggtggaccgttcggacgaaagggcaagggttcgaaactaacgaaaacgtgtggtagctcgctaaccg

SEQ ID NO: 331492 - DNA, 526 bp, Homo sapiens
  misc_feature: GZ8MTXP01CXGXF.17.39.D06.1.454.CMB.2.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (508)..(508): a, c, t, g, unknown or other
  misc_feature (508)..(508): n is a, c, g, or t
tcagcgtagactagcacgaccggtgctcgatttagtgacatctcgcagttcgtttggggggggaggaactgctcagttaggacccagacggaaccatggaagccccagcgcagcttctcttcctcctgctactctggctccagataccatggagaagtagtgatgacgcagtctccagccacctgtctgtgtctccgaaggggaaanacgccacctctcctgcagggccagtcagngtgtgcagcaatgctgancagcagaactgcagctccagctctnatgatggtncatcacgagggccagtggtctccacgcctaggttcaggtcggactagggtcgggtctaggggaactagggtacgttctctctacatcatcagcagcctagctagtctagaaagttgttttgggtacggttttataccgtgtacagtctaagttaatatccgaggtcgcctcggtgacggttcgaaccgtaagggaacttaggttagaaactgaaaacgtnttggcgactcgaactaac

SEQ ID NO: 331493 - DNA, 580 bp, Homo sapiens
  misc_feature: GZ8MTXP01BQ4BP.17.39.D06.1.454.CMB.2.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (301)..(301): a, c, t, g, unknown or other
  misc_feature (301)..(301): n is a, c, g, or t
  modified_base (479)..(479): a, c, t, g, unknown or other
  misc_feature (479)..(479): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaancgcccaccctctcctgcaggccagtcagngtgtgcagcaatgctgatcagcagaactggccaggcctcccgaggtcctcctcagtgtagtgggtncctatccgtaccgagggtcccacgttcgggtccgtccccgacgtccgtaggtttccgaggttcgggaacgtaggggttgggtaccgtggggacctaggtcgtttcctctctacatcgatcgagcgacgtcctgctagtcgtagtaagttgttttcgggacggtttttatacgtgtacncgtatagttaatagtcgagtcggtcctcggtggccggttcgacggtaaacggacgaaggttcgaaactaacggaaagtaacgtggacgttctcgcgtaacg

SEQ ID NO: 331494 - DNA, 627 bp, Homo sapiens
  misc_feature: GZ8MTXP01AP2W7.17.39.D06.1.454.CMB.2.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccacctgtctgtgtctccgaggggaaancgccaccctntcctgcagggccagtcagngtgtggcagcaacttagcctggtatcagcaagaacctggccaggcctcccgaggctcctcatgtatggtgctagtctaccgaggggccacgtcggtcgtcccgagcccgtaggttcgaggtcggactagggtcgggtcgtgggggactaggtggtttcctcgttacctctattcatcacggtcaggtccctgacctaggttctaggtaacgtttagtttttcggggtacggtttttaattacgtgttaccgagtactaagtttaataactcgtaggttcggtcccgttccgggtcggttaaccggttcccgggaccggtaaacggggtaacccgttaaggggttacgaaactaaccggaaacgtaacgtggtacgggctaaggcctaaccg

SEQ ID NO: 331495 - DNA, 601 bp, Homo sapiens
  misc_feature: GZ8MTXP01EJR0H.17.39.D06.1.454.CMB.2.raw
  modified_base (210)..(210): a, c, t, g, unknown or other
  misc_feature (210)..(210): n is a, c, g, or t
  modified_base (316)..(316): a, c, t, g, unknown or other
  misc_feature (316)..(316): n is a, c, g, or t
tcagcgtagactagcacgaccggtgctcgatttagtgacatctcgcagttctttgggggggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgcccaccctctcctgcagggccagtcagagtgtggcagctaattgctggatcagcaagaacctggacccaggccctacccgaggtcctcctacgatgtagtggtnctatccgtaccgacgggcctacgttcggcgtaccccaggtcccgtagggttccaggtcggacctaggggttcggggtcgtaggggactaggtagtttcctctctcagtcatcgagctacgtcctgctagtcgtagtaagttcgttttgggtacgtttatccgtgtccagtctaagttactatcgtaggtccgccgtcggtggacccggttacggaaccgaaacggggtaccttaaaggggttacttaaaacgtaaccgaaagtcgtggacgctcgaaccgtaacg

SEQ ID NO: 331496 - DNA, 696 bp, Homo sapiens
  misc_feature: GZ8MTXP01AQC2B.17.39.D06.1.454.CMB.2.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
tcagcgtagactagcacgaccggtgctcgatttagtgacatctcgcagttcgtttgggggggggaggaactgctcagttaggacccagacggaaccatggaagccccagcgcagcttctcttcctcctgctactctggctcccagataccactggagaagtagtgatgacgcagtctccagccacctgtctgtgtctccgaaggggaaancgcccacctctcctgcagggccagtcagtgtgtggcagctaacgttagccgtggtactcagacaacgaaccgtggacccaggcctcccgaggcctcctnattgtagtggtacnctatccgtaacccgagggcctacgttcggtcctacccgacggtcccgtagggttccgagggtcggtaccgtaaggggttcggggtacgtacgggggaactacggtacggtttcctccgttactactatacacgtcgacgctacggtcctagacgtagttacgtaggtaaagtttggttttacggggttacggttttaacttacgttacggtaccgtaaggtcttaaggttaacttaacgtcgtaacggttccgggtcccgttccgggtcgggttaccgggttaccgggaaccggtaaacggggtaaccggttaaagggttaacgttaaacgtaaccggaaaacgttcggtaggtcggttacgtcgcctaaccg

SEQ ID NO: 331497 - DNA, 530 bp, Homo sapiens
  misc_feature: GZ8MTXP01A9FQS.17.39.D06.1.454.CMB.2.raw
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtggcagcaacttgcctggtatcagcagaacctggccaggctcccaggcctcctnatgtatggncatctaccgngggccacgtggtctcccgagcccgtaggttccaaggtcgggaccgtagggttcggggtactcgggggaactaggtacgttcctcgtctcatcatcagcagcctgcagtctagtaatatttgggtcgtttatctgtcagctagtactatcgagtcgctcggtggacgtcggacgaacgggacagggttgaaactcgaaaagtcgtagcggctgcgaacg

SEQ ID NO: 331498 - DNA, 603 bp, Homo sapiens
  misc_feature: GZ8MTXP01ES959.17.39.D06.1.454.CMB.2.raw
  modified_base (205)..(205): a, c, t, g, unknown or other
  misc_feature (205)..(205): n is a, c, g, or t
  modified_base (400)..(400): a, c, t, g, unknown or other
  misc_feature (400)..(400): n is a, c, g, or t
tcagcgtagactagcacgaccggtgctcgatttagtgacatctcgcagttctttggggaggaactgctcagttaggacccagacggaaccatggaagcaccagcgcagcttctcttcctcctgctactctggctcccagataccactggagaagtagtgatgacgcagtctccagcccaccctgtctgtgtctccgaggggaaanagccaccctctcctgcagggccagtcagagtgttggcagcaacttagcctggtatcagcaagaaacctggaccaggcctcccgaggcctcctcatgtatggtgcactcgtaccgagggccctacgtggtcgtccccccaggccgtagggttcaggtgggctgggtcgggtctaggggactaggtagttctctctnatcatcagcagctgcagtctagtaaagttgttttaggcggttttaatcgttgtactagtctaaagttactaatcgtagggtcggtcccgttcgggttacgggtaccggttccgggaaacccggtaaagggggaacccgttaaagggggttacgtaaaacgtacgaaaacccgggtaagtcggttgggccttaacggaaccccg

SEQ ID NO: 331499 - DNA, 688 bp, Homo sapiens
  misc_feature: GZ8MTXP01CFHP1.17.39.D06.1.454.CMB.2.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgccaccctctcctgcgagggccagtcagagtgttggcagctaacttagcctggtatcagcagaacctggaccaggcctcccgaggcctcctcatgtatggtncctatcccgtaacgacggggacctacgtaggtccgtcccgacgtccccgtagggttcagggttcggacctaggggttcggggtcgtaggggactaggtacgtttcctcgttaccgtctactctactaccgaagcgtaacgtcccgtgaccgtagtacgtaggtaaagtttacgtttttacggggtacgggtttttaactaccgttaggtaccgtagtacttaaggttaattaacgtgtaacgggttcgcccggttcggtacggggaccggtttccgggaacccggtaaagggggtaaccccgttaaaaggggttacggttaaaacgtaacgtaaaaaacggtccgttagggtacgggttacctaacgggttcgttaaacccg

SEQ ID NO: 331500 - DNA, 581 bp, Homo sapiens
  misc_feature: GZ8MTXP01BQYAM.17.39.D06.1.454.CMB.2.raw
  modified_base (202)..(202): a, c, t, g, unknown or other
  misc_feature (202)..(202): n is a, c, g, or t
  modified_base (571)..(571): a, c, t, g, unknown or other
  misc_feature (571)..(571): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctcgaggggaangccacctctcctgcagggccagtcagagtgtggcagcaacttagcctggtatcagcaagaaacctggaccacggcctcccgaggcctcctcatgtacgtggtcgctactccgtaaccgacgggggtccctacgttcggtccgtccccgacggccccgtagggttccgagggttcgggaaccgtagggttcgggggtacgtcgggggaactaggttacgtttctacgttctacattcatcagcacgtcctgcgagtcgtagtaagttcgttttaggggtcgttttataccgtgtcagctagtatagtcgagtcgcctcggtggttaccgtcggacgaacgggacaagggttcgaaactcgaaacgcgtgnggctcgcgtc

SEQ ID NO: 331501 - DNA, 600 bp, Homo sapiens
  misc_feature: GZ8MTXP01EN16M.17.39.D06.1.454.CMB.2.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccacctgtctgtgtctccgaggggaaancgccaccctctcctgcagggccagtcagagtgtgcagcaacttagcctggtatcagcaagaacctggccaggcctcccgaggcctcctcatgtatggtcnctatcctaccgagggccacgtggtctcccagccgtaggttcaggtcggcagggtcggggtctgggggactaggtacgtttctctctactatcatcagcagcctgcagtctagtaagttgttttggggacgtttttaatcgtgtccaaggtctaagtaattacgtcgtaggtccggtcccgttcgggtacgggttaccggttccgggaaaccggaaacgggggtaacccgttaaaggggttacggaaaactcggaaaaacggtaacgttgggtacgggctaacggcctaaaccg

SEQ ID NO: 331502 - DNA, 613 bp, Homo sapiens
  misc_feature: GZ8MTXP01C1NN7.17.39.D06.1.454.CMB.2.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (504)..(504): a, c, t, g, unknown or other
  misc_feature (504)..(504): n is a, c, g, or t
  modified_base (592)..(592): a, c, t, g, unknown or other
  misc_feature (592)..(592): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccacctctcctgcaggccagtcagngtgtgcagctaacttgcctggtatcagcaagaacctggcccaggcctaccccgaggcctcctcagttcgtagtggtgccatcccgtaaccgacgggggcccctaacgttcggggtctacccccgacggtccccgtagggtttccaaggggttcggaccgtagggttcggggtctaggggacctaggtacgttctctctctagtcatcgacgcacgcctgactagttctaagtagttattttggggtacggttttataccgttgtcgacgtntagttaataatcgtacggtcgtcccgtcggtcgggttacgttccggacggtaaagggcccgaaagggttggaaacgttaacaaaccgngttgacggcctgccgtaaccg

SEQ ID NO: 331503 - DNA, 709 bp, Homo sapiens
  misc_feature: GZ8MTXP01BD3Y3.17.39.D06.1.454.CMB.2.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (305)..(305): a, c, t, g, unknown or other
  misc_feature (305)..(305): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgccaccctctcctgcaggccagtcagngtgtggcagcaacttgctggtatcagcaagaacctggaccaggcctcccgaggcctcctcatgtagtggtcnctatccgtaaccgaggggccctacgtcgggtcgtccccgagccccgtaaggttccgaaggtcggaccgaggggttcggggtccgtacgggggaaactagggttacgtttcgtccttctactaattccgaacttccgaacggtccgaaacggtccccgttaggaccgtacggttacgttaggtaaagtttacgttttttagggggtaccggttttttaattaccgttggttaaccgtaacgtaccgttaaaggttaataaacgttcgtaagggttccggtcccgttaaccgggtcgggttacccgggttacgggaccggaaacggggtacccggttaaaagggttacggaaaaacttaaccggaaaacggtaacgttacggtcgggttacctcgttcgtaacccg

SEQ ID NO: 331504 - DNA, 608 bp, Homo sapiens
  misc_feature: GZ8MTXP01ALI73.17.39.D06.1.454.CMB.2.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagngtgtgcagcaattgctggtancagcagaacctggccaggctcccgaggctcctcatgtatggtnctatcctaccgnggggcctacgtggtcgtccccagccctaggttcaggttggcctagggtcggggtctgggggactagggtagtttcncgttcctcaagtccatcaaggcacgcctagcctagttctaggtaagttgtttttcgggggacggtttttaaattcgtggttacaggtctaaggttacttaaatccgtaagggttcggcccttcgggtcgggacggtttccgggaccggtaaaggggacccgttaaagggggttcggaaaacttaaccgaaaacggtaacgttgggtacggcttaaggcctaaccg

SEQ ID NO: 331505 - DNA, 689 bp, Homo sapiens
  misc_feature: GZ8MTXP01C6KRA.17.39.D06.1.454.CMB.2.raw
  modified_base (176)..(176): a, c, t, g, unknown or other
  misc_feature (176)..(176): n is a, c, g, or t
  modified_base (208)..(208): a, c, t, g, unknown or other
  misc_feature (208)..(208): n is a, c, g, or t
  modified_base (263)..(263): a, c, t, g, unknown or other
  misc_feature (263)..(263): n is a, c, g, or t
tcagcgtagactagcacgaccggtgctcgatttagtgacatctcgcagttctttgggggggggaggaactgctcagttaggacccagacggaaccatggaagccccagcgcagcttctcttcctcctgctactctggctcccagataccactggagaagtagtgatgacgcagtcnccagccaccctgtctgtgtctcgaggggaaancgccaccctctcctgcgagggccagtcagtagtgttggcagctaattgctggtancagcaagaacctggaccaggcctccccgaggtcctcctcattgtactggtcactatcccgtaaccgacgggccctacgttcgggtccgtccccgacggtccccgtaagggttcgaagggttcggaccgtagggttcgggggtactcgggggaactacggtacgtttcctcgttctactatacacgttcgacgtcgacggtcctaggtacaggttcgtaaggttaagtttacgtttttacgggggttaacggtttttagtttaacgttcggtaacgtaggtacttaaggttaaacttaacgtccgtagggttccggtcccgttccgggtagggttaccggtttccgggaaccggtaaacggggtacgttaaagggttcgttaaaacgtaacgtaaaaccgtgtacggtcggttactcgaacctaacg

SEQ ID NO: 331506 - DNA, 644 bp, Homo sapiens
  misc_feature: GZ8MTXP01C92M4.17.39.D06.1.454.CMB.2.raw
  modified_base (208)..(208): a, c, t, g, unknown or other
  misc_feature (208)..(208): n is a, c, g, or t
  modified_base (309)..(309): a, c, t, g, unknown or other
  misc_feature (309)..(309): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccacctctcctgcagggccagtcagagtgttgcagcaacttagcctggtatcagcaagaacctggccaggcctcccgaggcctccgtcatcgtatggtnctactccgtaccgagggtcctacgtcggtcgtccccgacgcccgtaggttcaggtcggaccgtagggttcgggtcgtaggggactaggtacgtttctacgtctctagtcatcagcacggtcctgacgtagtctagtaaagttcgttttaggggtacggtttttataccgttgactagtactaaggttaatacgtacgtacgttcgggtaccccgttcgggtcgggttacccggtttaccgggacccgtaaacgggggtaacccttaaaagggggttccgaaaacgttaaccggaaaaacgtcggttacgggtcggaccgttaacggcccttaacg

SEQ ID NO: 331507 - DNA, 599 bp, Homo sapiens
  misc_feature: GZ8MTXP01A5NYI.17.39.D06.1.454.CMB.2.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (481)..(481): a, c, t, g, unknown or other
  misc_feature (481)..(481): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaancgcccaccctctcctgcagggccagtcagngtgtgnagctaactgcctggtatcagcagaacctgcaggcnccnggctcnatgtagtggtncactccgtaccgagggcctacgtcggtcgtaccgacgtccgtaggttcagtgggaacgtagggtcgggtctagggggactaggtcgttctcgtctacatcaactcgaacgtccgtacgtcctgaccgttagtcttaaggtaagtttcttttggggttacggttttattaccgtggtacacggtntaaagtttacctaatcggtagttccgggcctcgggtagttacccgggtcgaacggtaacggtaaccgagggttaagaactaacgaacggtaagttggcgggttactcggttcctaacg

SEQ ID NO: 331508 - DNA, 635 bp, Homo sapiens
  misc_feature: GZ8MTXP01C7DUW.17.39.D06.1.454.CMB.2.raw
  modified_base (201)..(202): a, c, t, g, unknown or other
  misc_feature (201)..(202): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (359)..(359): a, c, t, g, unknown or other
  misc_feature (359)..(359): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccacctgtctgtgtctcgagggaaannccacctntctgcagggccagtcagngtgtgcagctaatgctggtancagcagaactggaccaggcctccaggctcctcatgtatggtgactatctaccgaggccctagtcggttcaccacgcctaggttcaggtggacagtcggggtctaggggtanacggtatcgtactctactatcaatgaacgcaagcctggactacggttctagtaaagttatttttcggggtacggtttttaagttacctcggtactaacggtcttaacgggttaaattacgtccggttaaacggtcggttaaccccggttccggtttacggggttacccgggttacggaaccccgggtaaaggggaaaccgttaaaaggggttaccggttaaaacgtaacgaaaaaacccggtcgttaaggttcgggacttaacggaacccgtaacg

SEQ ID NO: 331509 - DNA, 535 bp, Homo sapiens
  misc_feature: GZ8MTXP01CCZOK.17.39.D06.1.454.CMB.2.raw
  modified_base (208)..(208): a, c, t, g, unknown or other
  misc_feature (208)..(208): n is a, c, g, or t
  modified_base (309)..(309): a, c, t, g, unknown or other
  misc_feature (309)..(309): n is a, c, g, or t
  modified_base (416)..(416): a, c, t, g, unknown or other
  misc_feature (416)..(416): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanacgccaccctctcctgcagggccagtcagagtgtggcagcaacttgcctggtatcagcaagaacctggccaggcctccccgaggcctcctcatgtatggtncatctaccagggccacgtggtctcccagcctaggttcagtggacaggttggggtctggggactaggtacgttctcgtctcatcatcagcagcctgcagtctagagtnttttggggcgttttatctgtcagtctaagttataatcgtagtcggccgttcggtggttcgtcggacgtaaaggggccaagggttcgaaactcgaaacgtaacgtggtgctgcgtaaccg

SEQ ID NO: 331510 - DNA, 569 bp, Homo sapiens
  misc_feature: GZ8MTXP01A2Q55.17.39.D06.1.454.CMB.2.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (257)..(258): a, c, t, g, unknown or other
  misc_feature (257)..(258): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
tcagcgtagactagcacgaccggtgctcgatttagtgacatctcgcagttctttgggggggggaggaactgctcagttaggacccagacggaaccatggaagccccagcgcagcttctcttcctcctgctactctggctcccagataccatggagaagtagtgatgacgcagtctccagcccacctgtctgtgtctaccgaggggaaancgcccacctctcctgcagggccagtcagngtgtgcagcaactgctgtnnagcagaacctggaccaggcctccgagtcctccacagtgtagtggagcatcctacgaggccagtggtctccagcctaggtcaggtcggaagcgggtggtcgtagggtacnggtattcgtctnactagtctagcagcacgtccgtgtacngttactaggtaaactttgttttggggacggtttttaacgtactcggtactagcttaaggttataacgtgtaacgtcggtcccgtcgttgggttaccgtcggaaccggtaaaggggaccttaagggttacgaaactaagaacgtgtcgagttccgaattcgaac

SEQ ID NO: 331511 - DNA, 592 bp, Homo sapiens
  misc_feature: GZ8MTXP01CYDTP.17.39.D06.1.454.CMB.2.raw
  modified_base (204)..(204): a, c, t, g, unknown or other
  misc_feature (204)..(204): n is a, c, g, or t
  modified_base (252)..(253): a, c, t, g, unknown or other
  misc_feature (252)..(253): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (275)..(276): a, c, t, g, unknown or other
  misc_feature (275)..(276): n is a, c, g, or t
  modified_base (284)..(285): a, c, t, g, unknown or other
  misc_feature (284)..(285): n is a, c, g, or t
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (457)..(457): a, c, t, g, unknown or other
  misc_feature (457)..(457): n is a, c, g, or t
  modified_base (549)..(549): a, c, t, g, unknown or other
  misc_feature (549)..(549): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaancgcccacctctcctgcgagggccagtcagtgtgtgcagctaatgctgnnagcagacngcagcnccngctcnntgatggtnntntcacgcggcacgtggtctccncgccgtaggttcaggtggaacgtagggtcgggtcgtaggggaactaggtacgttcctactctactatcctaatcgaagtcgacgtcccgtagacctagttcgttaagtaacgtttagttttggggttacggttttaattaccgtgttanacggtactaaggtttaactaacgtccgtaggtccgtccgttcgggtacgggttacggttaccgggacgttaaaacggggcgttaaaacgggngttaaactaacgaaacgtcgttaggccggattcgggcttaacg

SEQ ID NO: 331512 - DNA, 701 bp, Homo sapiens
  misc_feature: GZ8MTXP01D3XHC.17.39.D06.1.454.CMB.2.raw
  modified_base (209)..(209): a, c, t, g, unknown or other
  misc_feature (209)..(209): n is a, c, g, or t
  modified_base (259)..(260): a, c, t, g, unknown or other
  misc_feature (259)..(260): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgcccacctctcctgcagggccagtcagagtgtggcagctaatgctgtannagcagaactgaccaggcctcccgagcctcctcatgtatggtnctatcctacgngggtccagtggtctccccagcccgtaggttcgagtcggactagggtcgggtctcggggactaaggtcgtttcctcgttctacacttaccatccgaagtaccgaacggttccccttggacccgtaggttacgtaggttaaaagtttaccgttttttgggggttaacccggttttttaatttaacccgtgggttaaccaagtaccggttaaagttaaattaaaccgttccgtaacgggttccgggtcccgttaaccgggggtttacgggaacccggggtttacccggggaaaccggtaaaacgggggtaaacccgaaagggggtttacgaaaaacgtaacccgtaaaaacggtaagttcggggacggttactaacggaaccgttaacccg

SEQ ID NO: 331513 - DNA, 741 bp, Homo sapiens
  misc_feature: GZ8MTXP01EVC5T.17.39.D06.1.454.CMB.2.raw
  modified_base (204)..(204): a, c, t, g, unknown or other
  misc_feature (204)..(204): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgtggcagcaactagcctggtatcagcaagaacctggccaggctcccaggctcctcatgtatggtgactatacctaccgagggtccctacgtggtcgtaccccaggccctagggtttccaaggttcgggaactagggttcgggggtactaggggggtaaacctaggggtacggttttcctccgtttacttaccgaacgtttaccgaattcccggagaccgtacgggtcccttggacccgtagtttccgttaaaggtaaaaggtttgttttttacggggggttaccggggtttttttaaaatttaccggtgggtttaccaagtcgtttaaaggttaataaacgttccgtaaaggggtccggtccgttaacccggggtttggggttacccgggtttaaccgggaccggggtaaaacgggggtaacccgttaaaagggggttcgttaaaaaacggttccggaaaaaacggttaacgttacgggttaacgcgtccggttaacgtaaccccg

SEQ ID NO: 331514 - DNA, 622 bp, Homo sapiens
  misc_feature: GZ8MTXP01BBD07.17.39.D06.1.454.CMB.2.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (303)..(303): a, c, t, g, unknown or other
  misc_feature (303)..(303): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (495)..(495): a, c, t, g, unknown or other
  misc_feature (495)..(495): n is a, c, g, or t
  modified_base (597)..(597): a, c, t, g, unknown or other
  misc_feature (597)..(597): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaancgccacctctcctgcaggccagtcagngtgtgcagctaatgctggtatcagcagaacctggaccgaggcctcccgaggtcctcctctagtgtagtcggngtactatccgtacgcggccacgtcgtcgtccacgccgtaggttcgaggtcggctagggtcgggtcgtagggactagtcgttctctcnctatccatcagcgtacgtcctggacctagtntaggtaaagttagttttccggggtacggtttttaatagttcgtaaccgttagaccgtaagttaattaaccggtnttaaccgggttcggtcccgttaaccgggtacggttacccgggtttaccgggacccgaaaaggggtacccgaaggggttaacgaaacgttaaccgaaacggtntacgggtcggacttaagcctaaacg

SEQ ID NO: 331515 - DNA, 653 bp, Homo sapiens
  misc_feature: GZ8MTXP01AOKRQ.17.39.D06.1.454.CMB.2.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgcccaccctntcctgcagggtccagtcagagtgtggcagcaacttgcctggtancagcagaacctggccaggcctcccgagcctcctcatgtatggtcgctatctaccgagggcctacgtcggtctcccccaggtccccgaggtttccgaggttcggccgtaggttcggggtactagggggacctaggtcgtttcctctctctacttacattacgaggaccacgtcccgtaggctacgttcgtagtaagttattttttcggggaccgggtttttaattaccgttcgggttaccaggttacctaaggtttactaaacgttcgtaacggttccgggtccccgttcggtcgggttaccggttccggaacgtaaacggggacccgttaaggggttacgttaaacgtaaccgaaaacggtccgttagggtcgggctaacggcccgaaccg

SEQ ID NO: 331516 - DNA, 500 bp, Homo sapiens
  misc_feature: GZ8MTXP02GOJF7.17.39.D06.1.454.CMB.2.raw
  modified_base (203)..(203): a, c, t, g, unknown or other
  misc_feature (203)..(203): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggccaggctcccaggctcctcatgtatggtgcatctaccagggccactggtgtcccagccaggttcagtggcagtggggtctggggacagagttctctctcatcatcagcagcctgcagtctgaaagttntttgtcgtttatctgtcagnagtataatcagtcgcctcgtggtacgttcgacgaacgggacgaggtaggaaataacgaaacgacgtggtcgctacgacac

SEQ ID NO: 331517 - DNA, 497 bp, Homo sapiens
  misc_feature: GZ8MTXP02J16W8.17.39.D06.1.454.CMB.2.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggctcccaggctcctcatgtatggtncatctaccagggcccacgtggtcgtcccagcccaggttcaggtggcaggtggggtctgggggacagtagttctctctcatcatcagcagcctgcagtctgaagtattttgcggtttattactgtcagctagtataancagtgcctcgnggacgtcggacaaggccaaggtgaaactcgaaacgactgtgctgcac

SEQ ID NO: 331518 - DNA, 520 bp, Homo sapiens
  misc_feature: GZ8MTXP02HFMVI.17.39.D06.1.454.CMB.2.raw
  modified_base (205)..(205): a, c, t, g, unknown or other
  misc_feature (205)..(205): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
  modified_base (400)..(400): a, c, t, g, unknown or other
  misc_feature (400)..(400): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaangccaccctctcctgcagggccagtcagagtgtggcagcaacttgcctggtatcagcagaacctggaccaggctccaggctcctcatgtatggtncatctaccgngggccagtggtctcccagccaggttcagtggcagtggggtctgggacagtgttcnctctcatcatcagcagcctgctagtctagaaagttnttttgcgttttattactgtcagtcagttataatcgagtcgcctcggtggtaccgtcggacgaaacggggaccaagggtagaaaactaacgaaaacgacgttggtacggctacggacaacg

SEQ ID NO: 331519 - DNA, 523 bp, Homo sapiens
  misc_feature: GZ8MTXP02GIPR2.17.39.D06.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggccaggctcccaggctcctnatgtatggtncatctaccgagggccagtggtctcccagccaggttcagtggcaggtggggtctggggacagtagttcnctctcatcatcagcagcctgcagtcngaaagtnttttggcgttttatactgtacagctagtaatatcgagtcggccttcggtggtaccgttcggaccgaaaggggaccaagggtcgaaaatcgaaaacggactgggtcgactacggacctaacg

SEQ ID NO: 331520 - DNA, 582 bp, Homo sapiens
  misc_feature: GZ8MTXP02IA7ZO.17.39.D06.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (377)..(377): a, c, t, g, unknown or other
  misc_feature (377)..(377): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccacctgtctgtgtctccaggggaaangccaccctntcctgcaggccagtcagagtgtggcagcaacttgcctggtancagcagaaacctggccaggcctccaggctcctcatgtatggtncatctaccgaggggcccacgttggtcgtcccaagcccagggttcaggttggcaggtcgggtctgggaccagtgtttccnctcacatcatcagcacgcctgactagtctagtaagtttgttttggtacggtttttatacgttgtactagtactaagttataactcgtagggttccgtcccgttccgggtacgggttaccggttacggaaccggtaaacgggtaaccgtaaagggtaacgaaacgtaaccgaaacgtaacgttcggtacggtactacgtaccaccg

SEQ ID NO: 331521 - DNA, 518 bp, Homo sapiens
  misc_feature: GZ8MTXP02GFBNT.17.39.D06.1.454.CMB.2.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
  modified_base (408)..(408): a, c, t, g, unknown or other
  misc_feature (408)..(408): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaacctggccaggctcccaggcctcctcatgtatggtncatctaccaggggcccagtggtcgtcccagcccagggttcaggtggcaggtggggtcnggggacagtagttctctctcatcatcagcagcctgcagtctgaaagtnttttgcgttttattactgtcagcagtatatcagtggcctcggtggaccgttcggaccgtaagggaccaagggtaggaaatcgaaacgtaacgtggagcgtacgacaaccg

SEQ ID NO: 331522 - DNA, 559 bp, Homo sapiens
  misc_feature: GZ8MTXP02H9ZFP.17.39.D06.1.454.CMB.2.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagcccacctgtctgtgtctccgaaggggaaanagccaccctctcctgcagggccagtcagagtgttggcagcaacttagcctggtatcagcaagaaacctggccaggcctccgaggctcctcatgtatggtncatctacagggccacgtggctccagccaggttcaggtggcaggtcggggtntggggactaggtagtttcnctctacatcatcagcctagccctgcagtctagaaagttattttgacggtttttatactggtacagctaagtattaatcgtagtcggtccttcggtacgggtaccgttcggaccggtaaaacgggaccgaaagggttacggaaaactaacgaaaacgaaacgttggaggtacctagacctaaccg

SEQ ID NO: 331523 - DNA, 508 bp, Homo sapiens
  misc_feature: GZ8MTXP02H8N21.17.39.D06.1.454.CMB.2.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagcccacctgtctgtgtctccgaaggggaaangcccaccctctcctgcaggccagtcagagtgtggcagcaattagcctggtatcagcagaaacctggccaggcctcccaggctcctcatgtatggtncatctaaccgagggccacgtggctccagccaggtcaggtggcaggtgggtctggggacaggtagtttcnctcncatcatcagcagcctgcagtctagaatnttttggcgttttatacngtacagctaagtataancagtcgcctcggnggtaccgttcgaccgaagggaccaaggtagaaataacgaaacgaactggagctagacac

SEQ ID NO: 331524 - DNA, 520 bp, Homo sapiens
  misc_feature: GZ8MTXP02HYWAI.17.39.D06.1.454.CMB.2.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
  modified_base (319)..(319): a, c, t, g, unknown or other
  misc_feature (319)..(319): n is a, c, g, or t
  modified_base (367)..(367): a, c, t, g, unknown or other
  misc_feature (367)..(367): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgtggcagcaacttgcctggtancagcagaacctggccaggctcccaggctcctcatgtatggtgcatctaccagggccagtggngtcccagccaggttcagtggcaggtggggtctggggacaggtagttcnctctcatcatcagcagccctgcagtctagaagttattttgcggttttatactgtctagctagtataatcagtggcctcggtaggtcgttcggactaaagggacctaagggtagaaactaacgaaacgtaacgtggtaggaccttgacctaacg

SEQ ID NO: 331525 - DNA, 529 bp, Homo sapiens
  misc_feature: GZ8MTXP02HG3IQ.17.39.D06.1.454.CMB.2.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctgtctcccagataccactggagaagtagtgatgacgcagtctccagccaccctgtctgtgtctccaaggggaaanagcccaccctctcctgccagggccagtcagagtgtggcagcaacttagcctggtatcagcagaaacctggccaggctcccaggctcctcatgtanggtncatcacgaggcagtggtctccacgctagtcagtggcaggtgggtcgtgggacagtattctctctcatcatcagcacgctcgcagtacgtagtaagtagtttagttacgtttagttacttagtagagacagtaataatatagtcgtcgtcgtcggtacgtacgtacgaacggaacgaacggtaaggaaacgtaacgaaacgaaacgtacgtagtacgtacgacgacg

SEQ ID NO: 331526 - DNA, 519 bp, Homo sapiens
  misc_feature: GZ8MTXP02HSCEA.17.39.D06.1.454.CMB.2.raw
  modified_base (203)..(203): a, c, t, g, unknown or other
  misc_feature (203)..(203): n is a, c, g, or t
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtggcagcaacttagcctggtancagcagaaacctggccaggcctccgaggcctcctcatgtatggtncatctaccgagggccacgtggtctcccagccaggttcagtgcaggtgggtctggggacaggtagttcnctctcatcatcagcagcctgcagtctagaagttnttttggacgttttatactgtcagctagtatatcagtcgcctcgtggtacgttcggaccgaaagggaccaagggtacgaaaataacgaaaacggaacgtggtaggactagacctacg

SEQ ID NO: 331527 - DNA, 524 bp, Homo sapiens
  misc_feature: GZ8MTXP02IOPP8.17.39.D06.1.454.CMB.2.raw
  modified_base (202)..(202): a, c, t, g, unknown or other
  misc_feature (202)..(202): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttggcagcaacttagcctggtatcagcagaacctggccaggctccccaggctcctcatgtatggtgcatcctaccagggcccagtggtctcccagccaggttcaggttgcagtggggtctggggacagcgttctctctcatcatcagcagccctgctagtcngaagttnttttgacgttttattactgtacagtcagttataatcagtcgccctcggtggacgttcggacaaacgggaccgtaaggtcgaaaatcgaaaacgtaacgtggtacggcttaggacctaaccg

SEQ ID NO: 331528 - DNA, 529 bp, Homo sapiens
  misc_feature: GZ8MTXP02GB1CW.17.39.D06.1.454.CMB.2.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
  modified_base (368)..(368): a, c, t, g, unknown or other
  misc_feature (368)..(368): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccacctctcctgcagggccagtcagagtgtggcagcaacatagcctggtatcagcagaacctgcagctccaggctctnatgtatggtncatctacgagggccagtcggtntccccccagccctaggttccagtcggctgggtgggtctggggacaggtagtttcnctctcatcatcagcagctagcagtctaggaattattttggacgtttattacgtgtacagtctagtaatatcgagtcggtcctcggtaggtaccgttcggaccgaaacggggacctaagggtacgaaaagtaccgaaaacggtactggtacggctacgaccg

SEQ ID NO: 331529 - DNA, 644 bp, Homo sapiens
  misc_feature: GZ8MTXP02HONJK.17.39.D06.1.454.CMB.2.raw
  modified_base (194)..(194): a, c, t, g, unknown or other
  misc_feature (194)..(194): n is a, c, g, or t
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (382)..(382): a, c, t, g, unknown or other
  misc_feature (382)..(382): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagatactactggagaaatggtgatgacgcagtctccagccacctgtctgtttcnccgaggggaacagccacctctctgcagggccagtcagagtgtgagcagcaacttagcctggtatcagcaagaaacctggccaggcctccaggctcctcatctatggtnccttccacgagggccnctggtcgcccagcccagatcgaggggcaggtgggtctggggacagtagttccactctacaccancagcacgtcctcgacgtacgtacgtagtaagttagtttagttacgtttaagtttaacgtttacgttacgttacgtacgtacgtaacttaaactaaacgttaaaccggtaccgggggtacccccggggggtaacccggggttaaccggggtaaccgggtaaaaccggggtaaaccgggtaaacgggtaacggggtaaacggtaacgtaaacgtaaaacggtaaacgtaacggtacggtacgtacgacgaccgtacgtacgtcg

SEQ ID NO: 331530 - DNA, 528 bp, Homo sapiens
  misc_feature: GZ8MTXP02G4YV7.17.39.D06.1.454.CMB.2.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaacctggccaggctccaggctcctnatgtatggtncatctaccgagggcccagtggtctcccagcccaggttcaggtggcaggtggggtctggggactagngtttcnctctcatcatcagcagcctgcagtctagaagtnttttggacggttttatacgtgtcagctaagttataatcagtcgcccttcggtgggtaccgttcggacgaaacgggaccaagggtcgaaaatcgaaaacgtaactggtacggactcggactaaccg

SEQ ID NO: 331531 - DNA, 524 bp, Homo sapiens
  misc_feature: GZ8MTXP02F4EVO.17.39.D06.1.454.CMB.2.raw
  modified_base (206)..(206): a, c, t, g, unknown or other
  misc_feature (206)..(206): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (407)..(407): a, c, t, g, unknown or other
  misc_feature (407)..(407): n is a, c, g, or t
tcagcgtagactagcacgaccggtgctcgatttagtgacatctcgcagttctttggggggaggaactgctcagttaggacccagacggaaccatggaggccccagcgcagcttctcttcctcctgctactctggctcccagataccactggagaagtagtgatgacgcagtctccagccaccctgtctgtgtctccgaggggaaanagccaccctctcctgcagggccagtcagagtgttggcagcaacttagcctggtatcagcagaacctggccaggctcccaggctccnatgtatggtncatcctaccgagggcccagtggtctcccagccaggttcaggtggcaggtggggtctggggacagtagttctctctcatcatcagcagcctgcagtctgtaaagtntttgtcggtttattactgtacagctagttataatcagtcggccttcggtggacgttcggacgaaacgggaccgaaggtcggaaaatcgaaaacgacgtggtacggactcgactaacc

SEQ ID NO: 331532 - DNA, 714 bp, Homo sapiens
  misc_feature: GZ8MTXP02I29TR.17.39.D06.1.454.CMB.2.raw
  modified_base (206)..(206): a, c, t, g, unknown or other
  misc_feature (206)..(206): n is a, c, g, or t
  modified_base (259)..(259): a, c, t, g, unknown or other
  misc_feature (259)..(259): n is a, c, g, or t
  modified_base (485)..(485): a, c, t, g, unknown or other
  misc_feature (485)..(485): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttggcagactatcgcgtagtacncgagacaacgaacgtcggaccgacggtccctacccgacggtcccttcccacgtagttacgttaggttggtcgacctacttaccccgtaaccgggacgggtacccctaacggttccgggccccgttaccccgaccggtaccccgttagggtttaccgacggggtcggaccgttaggggttcggggtcggtacggggactaggttccgttctcgttctactatactanacgacgcgacgtccgtagacgtagtcgtagtaaagtttgttttcgggtacgtttttaactcgttgtacgacgtagtaattaattaaactcgtaaggtccggtcccgttacgggtacgggttacccggttacccgggaaacggtaaaccgggtaaccgtaaaaggggtaacgtaaaaccgtaaaccggaaaaccgttaagtcgggtacggtaccgtacggaccctaaacg

SEQ ID NO: 331533 - DNA, 554 bp, Homo sapiens
  misc_feature: GZ8MTXP02H42KV.17.39.D06.1.454.CMB.2.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (409)..(409): a, c, t, g, unknown or other
  misc_feature (409)..(409): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanagcccaccctctcctgcaggccagtcagagtgtggcagcaacttgcctggtatcagcaagaaacctggccaggcctcccaggcctcctcatgtatggtncatctaccgaggccacgtggcgtcccagccaggttcaggtgcaggtgggtctagggactagtagttcctctctctatcatcagcagcctgcagtctagaaagttnttttggcgtttttatactggtcagctaagtataattcaggtggtacccttcggtaggtaccggttacggacccgaaaggggtaacccaaaggggttacggaaaacttccggaaaaaccgacgttggacggtcctaggaccaaccg

SEQ ID NO: 331534 - DNA, 519 bp, Homo sapiens
  misc_feature: GZ8MTXP02JO7YE.17.39.D06.1.454.CMB.2.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (397)..(397): a, c, t, g, unknown or other
  misc_feature (397)..(397): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtggcagcaacttgcctggtatcagcagaacctggccaggctccaggctccncatgtatggtncatctaccagggcccagtggtcgtccagccaggttcaggtggcaggtggggtctggggacagtgttctctctcatcatcagcagcctgcagtctagaagtnttttgcgttttatactgtacagtcaagtataanctagtcgccttacggnggtacgttcggacgtaacgggaccgtaaggtacgaaagtaacgaaaacgtacgtcggtggactacgaccaacg

SEQ ID NO: 331535 - DNA, 492 bp, Homo sapiens
  misc_feature: GZ8MTXP02GUDBS.17.39.D06.1.454.CMB.2.raw
  modified_base (204)..(204): a, c, t, g, unknown or other
  misc_feature (204)..(204): n is a, c, g, or t
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (458)..(458): a, c, t, g, unknown or other
  misc_feature (458)..(458): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgtggcagcaacttagcctggtancagcagaacctggccaggctccagctcctnatgatggtncatctaccgagggccagtggctccagccaggtcagtgcagtgggctgggacagtgttcntctcatcatcagcagcctgcagtctagaaatntttgacgtttatactgtcagnagtanatcagtgctcggtggacgttcggacaaagggacaaggtaggaaaanaacgaaaacggaactcggtaggactcggacaacg

SEQ ID NO: 331536 - DNA, 603 bp, Homo sapiens
  misc_feature: GZ8MTXP02IQ2AG.17.39.D06.1.454.CMB.2.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngcccaccctctcctgccagggccagtcagngtgtggcagcaacttgcctggtatcagcagaacctggccaggctcccaggcctcctcatgtatggtncatcctaccgagggccctagtgggtcgtccccagcccgaggttccaggtcggcaggtggggtctggggacagtgttctctctcatcatcagcagccctgctagtctgtaagttagtttttggcggtttttaattaccgtgttccaagtctaaggttactaaagttctaaggtcggtaccctttccgggttacggggtaccggtttccggggaacccggtaaacgggggtacccgtaaaggggttcgggaaaaattccgaaaaacggtaaccgttgggtacggacgttacggacctaacccg

SEQ ID NO: 331537 - DNA, 529 bp, Homo sapiens
  misc_feature: GZ8MTXP02G437P.17.39.D06.1.454.CMB.2.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttggcagcaacttgcctggtatcagcagaacctggccaggctccgaggctcctcatgtatggtncatcctaccgagggccagtggtctccagccaggttcagtgcaggtggggtctggggacagtgttcnctctcatcatcagcagcctgctagtctagaagttnttttggcgttttatacgtgtacagtctagtataatcagtcggccttcggtacgtacggttcggacgaacggggtacctaaggggtacgaaaacgtcgaaaacgtacgtaggtcggactacggactaaccg

SEQ ID NO: 331538 - DNA, 524 bp, Homo sapiens
  misc_feature: GZ8MTXP02IQZ45.17.39.D06.1.454.CMB.2.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccacctctcctgcagggccagtcagagtgttggcagcaacttagcctggtatcagcagaacctggccaggctcccaggctccnatgtatggtncatcctaccgagggcccactggtcgtccccaggccctagggttcaggtcggacagggtggggtctggggaacagtacgttctcgtctcattccatcagcagccctgctagtctagtaagtagttttggcggttttattacgtgtcagtcagtataatcgagtgcctcgtgcgttcggacaagggccaaaggtgaaaactcgaaacgtaatcggtaggctacggctacg

SEQ ID NO: 331539 - DNA, 503 bp, Homo sapiens
  misc_feature: GZ8MTXP02I7BTV.17.39.D06.1.454.CMB.2.raw
  modified_base (203)..(203): a, c, t, g, unknown or other
  misc_feature (203)..(203): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaacctggccaggctccaggctccnatgtatggtncatcctaccagggcccagtggtctcccagccaggttcaggtgcaggtggggtctggggacagtgttcnctctcatcatcagcagcctgctagtctgaaagtnttttggcggttttatactgtacagtctagtataatcgtagtcgccttcggtggtacgttcggacagggaccaaggtgaaaatcgaaacgactgaggctgactac

SEQ ID NO: 331540 - DNA, 682 bp, Homo sapiens
  misc_feature: GZ8MTXP02ID7E2.17.39.D06.1.454.CMB.2.raw
  modified_base (206)..(206): a, c, t, g, unknown or other
  misc_feature (206)..(206): n is a, c, g, or t
tcagcgtagactagcacgaccggtgctcgatttagtgacatctcgcagttctttgggggggagaactgctcagttaggacccagacggaaccatggaagccccagcgcagcttctcttcctcctgctactctggctcccagataccatggagaagtagtgatgacgcagtctccagccacctgtctgtgtctccgaaggggaaacncgccacctctctgcgacggccagtcagtagtgtggacagactaacgttagcgtaggtatacagacgaacgaaaccgtcggaccgacggtcctaccgacggtcctcctactagtagtagtggtacgactaacgtaccgtaaccggacgggtaccctaacgttcgggtccgtacccgaaccgtccgtaacggttcgtaggtcggacgtagggttcggggtacgtagggactaggttactttctctctactatactactcgacgcgacgtacgtcgtacgtacgtacgtacgtaagtttagtttagtttacggttttaacgtttacgttacgtacgtacgtacgtaagtaagtaacgtacgtacgtacgtaccgtacggtacggtacggttacggtaaccggtaaacggaaacggtaaacggtaaacggtaaacgtaaacgtaaaacgtaaacgtacgtacggtacgtacgtacgtacg

SEQ ID NO: 331541 - DNA, 565 bp, Homo sapiens
  misc_feature: GZ8MTXP02JZHG1.17.39.D06.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (409)..(409): a, c, t, g, unknown or other
  misc_feature (409)..(409): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaangccaccctctcctgcagggccagtcagngtgttggcagcaacttagcctggtatcagcagaacctggccaggctccaggctcctcatgtanggtncatctacgngggccagtggtctcccagccaggttcaggtggcaggtggggtctgggggacaggagtttctcgtctcatcatcagcagcctgacagtctagaaagtntttggcggtttatactgttacagtctagtaatatgagttggccttccggtagggtaccggttcgggacccgaaagggggacccgtaaaggggtacggtaaaacgtaaccgaaaaccgtaaacggtttggtaacggcccgttaggaccctaaacccg

SEQ ID NO: 331542 - DNA, 580 bp, Homo sapiens
  misc_feature: GZ8MTXP02IKM5V.17.39.D06.1.454.CMB.2.raw
  modified_base (207)..(207): a, c, t, g, unknown or other
  misc_feature (207)..(207): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangcccacctctcctgcagggccagtcagagtgtggcagcaacttgcctggtancagcagaacnggcaggctccaggctctnatgtatggtncatcctacgagggcctacgtggtctcccagccctaggttcaggtggctagggtggggtctggggaactagtacgtttcactctctatcatcagtcagtccctgactagtctaggtaaagttcttttggacgtttttatcgtgtacagtactaagttaactaagtcgtaaggtcggtccctttacgggtacgggtaaccgtttccggggaaccgtaaaacggggacccgtaaaaggggttacgaaaactaacgaaaacggtacgtggtacgcgtacgactaacg

SEQ ID NO: 331543 - DNA, 669 bp, Homo sapiens
  misc_feature: GZ8MTXP02I0OTJ.17.39.D06.1.454.CMB.2.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttggcagcaacttgcctggtatcagcagaacctggccaggctccaggctccnatgtatggtncatcctaccgngggccacgtggtctcccagccaggttcaggtggcaggtggggtctgggggactaggtagttcctcttctacgacttcaattccgaagccgacggtcccctaggcctaaggttccgtaggtaaaagttcgttttttcgggaccggttttttaattaccgttgggtacctaaggtactaaagttaacttaaattcgtaaggttccgggaccccgtttccgggttacgggggtacccggtttacccggggaaacccggtaaaacgggggtaacccgtaaaagggggttaacggtaaaaacgttaaccgaaaaaaccgggtaacggttacgggtaacggcccgttacggacccgtaaacccg

SEQ ID NO: 331544 - DNA, 578 bp, Homo sapiens
  misc_feature: GZ8MTXP02IYAFT.17.39.D06.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagngtgtgcagcaacttagcctggtatcagcagaacctggccaggctcccaggcctccnatgtatggtncatccgtaccaggggcccacgtggtcgtcccagtcccagggttcaggtggcagggtcggggtctggggactaggtagtttctctctcattcatcagcagccctgctagtctagtaaagttagttttggtacggttttaattacgttggtacaagtctaagttaataagtcgtagtcggtccttcgggtcggtaccggtttcgggaccgtaaacggggaccgtaaagggtacggaaaactaacgaaaacgtacgtaggtacgtcgtacggactaaccg

SEQ ID NO: 331545 - DNA, 535 bp, Homo sapiens
  misc_feature: GZ8MTXP02FQ2OU.17.39.D06.1.454.CMB.2.raw
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (415)..(415): a, c, t, g, unknown or other
  misc_feature (415)..(415): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttggcagcaacttagcctggtatcagcagaacctggccaggctccaggcctcnatgtatggtncatcctaccgaggggcccagtggtcgtcccagccctaggttcaggtggcagggtcggggtctggggacaggtacgttctcgtctcattcatcagcagcctgcagtcagtaagtntttggcgtttattactgtcagtctagtataatcgagtcggcctcggtggtacgttcggaccaaggggaccgtaaggtagaaaactaacgaaaacgtacgtggtaggactacgactaaccg

SEQ ID NO: 331546 - DNA, 503 bp, Homo sapiens
  misc_feature: GZ8MTXP02FNNBR.17.39.D06.1.454.CMB.2.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtggcagcaattagcctggtatcagcagaacctggccaggctcccaggctcctcatgtatggtgcatctaccaggggccacgtggtcgtcccagcccaggttcaggtggcaggtggggtctggggacaggtagttctctctcattcatcagcagcctgcagtctgaatntttgcgtttatactgtcagntagtatatcagtcggcctcggtggacgttcggaccgaaggaccgaaggtgaaaatcgaaaacgactggtagctagctaacg

SEQ ID NO: 331547 - DNA, 540 bp, Homo sapiens
  misc_feature: GZ8MTXP02GRWIL.17.39.D06.1.454.CMB.2.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (451)..(451): a, c, t, g, unknown or other
  misc_feature (451)..(451): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctccagataccactggagaagtagtgatgacgcagtctccagccacctgtctgtgtctcgaaggggaaanacgccaccctctcctgcagggccagtcagngtgtgcagcaatgctggtancagcaagaacctggccaggcctccgaggctccnatgtatggnctatcctaccgagggcccagtggtctcccagccgtaggttcaggtggcagggtcggggtcgtagggacaggtcgttcactctcatcatcagcacgcctgcagtctagtaaagttgtttgtacggtttatacgttgtacagtctaagtataacngtagtcgactcggtaggaccgttcggacgtaaacgggaccgaaaggtacgaaagtaacgaaaacgtaagacgtagacgtacgactaacg

SEQ ID NO: 331548 - DNA, 540 bp, Homo sapiens
  misc_feature: GZ8MTXP02GA73G.17.39.D06.1.454.CMB.2.raw
  modified_base (208)..(208): a, c, t, g, unknown or other
  misc_feature (208)..(208): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (410)..(410): a, c, t, g, unknown or other
  misc_feature (410)..(410): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttggcagcaacttagcctggtatcagcaagaaacctggccaggcctcccaggcctccncatgtatggncatcctaccgagggccagtggtctcccagcccaggttcagtggcaggtgggtctggggacagngttcnctctcatcatcagcagcctgcagtcagtaaagtntttggacgttttatactgtacagtctaagtataatcgagtcgcctcggtcgggtacgttcggaccgtaaagggaccgaaggtacggaaaataaccgaaaacgtacgttaggacggtacacggactaaccg

SEQ ID NO: 331549 - DNA, 587 bp, Homo sapiens
  misc_feature: GZ8MTXP02GPKFI.17.39.D06.1.454.CMB.2.raw
  modified_base (204)..(204): a, c, t, g, unknown or other
  misc_feature (204)..(204): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (352)..(352): a, c, t, g, unknown or other
  misc_feature (352)..(352): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttggcagcaacttgctggtatcagcagaacctggccaggctcccaggctcncatgatggtnctatcctaccgagggccagtggtctcccagccaggttcagtggctaggtggggtcnggggacagtcgttctctctcatcatcagcacgcctgcgtagtcgtagtaaagtttgttttaggtcggtttttaataccgttggttaccagtacgtaagttaactaactcgtaggtcgggtcccgttaccgggtacggggtaaccgtttccggggaaccggtaaacgggggaacccgtaaaggggtacggaaaacgttaacgaaaaacggtacgtggacggtctacggacctaacg

SEQ ID NO: 331550 - DNA, 606 bp, Homo sapiens
  misc_feature: GZ8MTXP02GZK39.17.39.D06.1.454.CMB.2.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (304)..(304): a, c, t, g, unknown or other
  misc_feature (304)..(304): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctntcctgcagggccagtcagngtgttggcagcaacttgcctggtatcagcaagaacctggccaggctccaggcctcctcatgtatggtnctatcctaccgagggccctagtcggtcgtcccagcctaggttcaggtggctagggtggggtctagggggactagtcgttctctctcatcatcagctacgcctggctagtcgtagtaaacgttgtttttggacggtttttattaccgtggttacacgtacgtaagttaataaacgttcgtacggtcggtcccgtttcgggtacggtaccggtttaccgggaaccggaaacgggggtaaccgtaaacggggttagaaaacgtaacgaaaacggtaacgttcggagtacgtacggtacctaaccg

SEQ ID NO: 331551 - DNA, 518 bp, Homo sapiens
  misc_feature: GZ8MTXP02JKKFV.17.39.D06.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttggcagcaacttagcctggtatcagcagaacctggccaggctcccaggctcctnatgtatggtncatctaccgagggcccatggtctcccagccaggttcagtggcaggtgggtctggggacagngttcnctctcatcatcagcagcctgcagtctagaaagtntttggacggttttatacgtgtacagtctagtataatcgagtcgcctcgtggtacgttcggacgaaacgggaccaaagggtgaaacgtaacgaaaacggtaactggacgcgtagacctac

SEQ ID NO: 331552 - DNA, 549 bp, Homo sapiens
  misc_feature: GZ8MTXP02G5JWN.17.39.D06.1.454.CMB.2.raw
  modified_base (301)..(301): a, c, t, g, unknown or other
  misc_feature (301)..(301): n is a, c, g, or t
  modified_base (408)..(408): a, c, t, g, unknown or other
  misc_feature (408)..(408): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttggcagcaacttagcctggtatcagcagaacctggccaggctcccaggctcctcatgtatggtncatctaccgagggcccagtggtctcccagccaggttcaggtggcaggtggggtctaggggactagtacttctactctcatccatcagcagcctgcagtctagaagtnttttgacggttttatacgtgtcagctagtataactgagtcggtcctacggtggtaccggttcggaccgtaaacggggaccgtaaagggtacgaaaacgtaacgaaaacgtaccgttaggtacggtactacggacgtaaccg

SEQ ID NO: 331553 - DNA, 589 bp, Homo sapiens
  misc_feature: GZ8MTXP02HO669.17.39.D06.1.454.CMB.2.raw
  modified_base (207)..(207): a, c, t, g, unknown or other
  misc_feature (207)..(207): n is a, c, g, or t
  modified_base (301)..(301): a, c, t, g, unknown or other
  misc_feature (301)..(301): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgttggcagcaacttgcctggtatcagcagaaacctggccaggctcccaggctctcatgtatggtncatcctaccgagggcccacgtggtctccacgccgtaggttcaggtggaaacgtgggtcgggtcgtgggactaggtacttctctctactatctatcgagcacgtcccgtgacgtagttacgtaaggtaaagtttagttttcggttacggtttttaatacgttggtacagtactaagttaataactcgtaggtcgtccgttacggtcgggtaccggttcggaacggaacggtaaccggaaggtaagaaaacgtaaccgaaaaggtacgtaggtacgtactacgactaacc

SEQ ID NO: 331554 - DNA, 525 bp, Homo sapiens
  misc_feature: GZ8MTXP02HKG1S.17.39.D06.1.454.CMB.2.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaacctggccaggctccaggctcctnatgtatggtgcatctaccgagggccacgtggtcgtcccagcccaggttcaggtggcaggtggggtctggggaccagtagttcnctctctatcatcagcagcctgcngtctgagtntttgcggttttatacgtgtcagtctagtataagtcagtcgccgtcggtggtaccggttcggaccgtaacggggaccaagggtacgaaataacgaaacgtactaggtgacctaggactaaccg

SEQ ID NO: 331555 - DNA, 631 bp, Homo sapiens
  misc_feature: GZ8MTXP02HSMEQ.17.39.D06.1.454.CMB.2.raw
  modified_base (207)..(207): a, c, t, g, unknown or other
  misc_feature (207)..(207): n is a, c, g, or t
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (413)..(413): a, c, t, g, unknown or other
  misc_feature (413)..(413): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgttggcagcaacttagcctggtancagcagaaacctggccaggcctcccaggcctcctnatgtatggtgcatcctaccgagggcccagtggtcgtcccagccaggttcaggtgcaggtggggtctggggacagtagttcncttcncatcatcagcagcctgcagtctagaaagtttntttggtacgttttatcgtgtacagtactaagttaattaacgtcgtaaggtccggtacccgtttaccgggttacggggttacccggtttaccggggaaacccggtaaaacgggggtaacccgtaaaacgggggttaacggtaaaaaacgtaaacccggtaaaaacggttaaaccggtttcggggtaaccggtacccgttaacggtaacccgtaaacccg

SEQ ID NO: 331556 - DNA, 583 bp, Homo sapiens
  misc_feature: GZ8MTXP02G5WBH.17.39.D06.1.454.CMB.2.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttggcagcaacttagcctggtancagcagaacctggccaggctccaggctcctcatgtatggtgcatccgtaccaggggcccacgttgggtcgtccccaggcccaggtttcaggttcggcaggtggggtctggggaccaggtagttcnctcnatcatcagcagcctgctagtctagtaaagtgtttttggcggtttttattaccgtggttaccagtctaagttattaatcgaggttcggtcccttacggtgggtaacgtttcccggacggaaacggggtacccgtaaaggggtacgaaaacgtaaccgaaaacggtaaccgttgggtaccggcttacggccctaaaccg

SEQ ID NO: 331557 - DNA, 513 bp, Homo sapiens
  misc_feature: GZ8MTXP02J1MTS.17.39.D06.1.454.CMB.2.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (438)..(438): a, c, t, g, unknown or other
  misc_feature (438)..(438): n is a, c, g, or t
  modified_base (463)..(463): a, c, t, g, unknown or other
  misc_feature (463)..(463): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctntcctgcagggccagtcagagtgttggcagcaacttgcctggtatcagcaagaacctggcccaggcctcccgaggcctcctnatgtatggtncatctaccgagggccagtggctccccgagcccaggttcaggtcggctaggtggggctggggacngtacgttctcnctctatcatcagcagcctgcagtctagaagttgtttgacgtttatacgtgtacngactagtatagtcagtcgcttcggngacggtcggacacgggacaggtagaaatcgaaacgacgtgcgctcgcacg

SEQ ID NO: 331558 - DNA, 727 bp, Homo sapiens
  misc_feature: GZ8MTXP02IB0PA.17.39.D06.1.454.CMB.2.raw
  modified_base (208)..(208): a, c, t, g, unknown or other
  misc_feature (208)..(208): n is a, c, g, or t
  modified_base (259)..(259): a, c, t, g, unknown or other
  misc_feature (259)..(259): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccacctgtctgtgtctccgaaggggaaangccaccctctcctgcaggccagtcagagtgtggcagcaacttgctggtacncagacaacgaacgtcggaccgacggcctacccgaggtccttccctacgtagttaggtacgtggtactacctacgttacccgtaaccggacgggtaccctacggttcgggtaccgtacccgaccggtacccgtagggttcgaggggttcggacgttaggggttcgggggtacggtaggggaacgttacgggttacgtttcctacttcctactactactactacgacgtccgtacgtcccgtggacctacgttacgttaaaggttaaacgttttaggtttttacggttaacggttttttaattacgttacggtacgtaggtaacttaagttaacttacgtacgtacgggtcggtacccgttcgggtacgggttaccggttacggaaccgggtaaacgggtaaaccgtaacgggttaaacgaaacgtaaaccgtaaaacggtacgttacggtacggtacctacgtaccacg

SEQ ID NO: 331559 - DNA, 504 bp, Homo sapiens
  misc_feature: GZ8MTXP02GJ2N5.17.39.D06.1.454.CMB.2.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (498)..(498): a, c, t, g, unknown or other
  misc_feature (498)..(498): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaacctggccaggctcccaggctcctnatgtanggtncatctaccagggccatggtctcccagtccaggttcaggtggctaggtcggggtctggggacaggagtttctactctcatcatcagcagcctgcagtcagaagtatttgacgtttatactgtcagtcagtataancagtgcctcgnggacttcggacaagggtaccaagggtgaaaactcgaaaacgagtcgaggtcngtacac

SEQ ID NO: 331560 - DNA, 557 bp, Homo sapiens
  misc_feature: GZ8MTXP02JNMB9.17.39.D06.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagngtgtggcagcaacttgctggtancagcagaacctggccaggctccaggcctcnatgtatggtncagtcctaccgagggcctagtggcgtccagcctaggttcaggtcggctaggtggggtctggggactaggtcgtttctcttctacattccatcgagccgacgcctgctagtctagtaaagttgttttggtacggttttatacgtgtacagtctaagttatagtcgtaggtcgccgttcggtaggtaccgttcgggacgaaacggggtaccgtaagggtacgaaaactcgaaaacgtacgtggagtctacggacctacg

SEQ ID NO: 331561 - DNA, 565 bp, Homo sapiens
  misc_feature: GZ8MTXP02JFNYO.17.39.D06.1.454.CMB.2.raw
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaanagccaccctctcctgcagggccagtcagagtgttggcagcaacttgcctggtatcagcagaacctggccaggctcccaggcctcncatgtatggtncatcctaccgagggcccagtggtcgtccccagccaggttcaggtgcgaggtggggtctggggactagtagttctctctcattccatcgagcacgccctggactaggtctagtaaacgtntttttaggcggttttattaccgtgttacngtacaagttanaatcaggttcgaccgttcggtggtacggttccggaaccgtaaggggacctaaagggtcggaaaactcgaaaacgtacgtggtacggacctaggacctaaccg

SEQ ID NO: 331562 - DNA, 541 bp, Homo sapiens
  misc_feature: GZ8MTXP02G0G69.17.39.D06.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (378)..(378): a, c, t, g, unknown or other
  misc_feature (378)..(378): n is a, c, g, or t
  modified_base (411)..(411): a, c, t, g, unknown or other
  misc_feature (411)..(411): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtggcagcaacttagcctggtatcagcagaacctggccaggcctccaggcctcctnatgtatggtgcatcctaccgagggccctagtggtcgtcccagtccaggttcaggtcggctagggtggggtctgggggactagtcgttcnctctcatcatcagcagcctgcagtcagtaagtntttgacgtttatacgtgtacagctagtataactgagtcgaccgttcggtaggtaccgttcggaccgaaaggggtaccgaagggtacggaaaactaacgaaaacggtacgtggtacggctacggacaaccg

SEQ ID NO: 331563 - DNA, 676 bp, Homo sapiens
  misc_feature: GZ8MTXP02HQ5FT.17.39.D06.1.454.CMB.2.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccaccctctcctgcgagggccagtcagngtgttggcagctaacttagcctggtatcagcaagaacctggccaggcctcccgaggtcctcctcagtgtagtggtnctatcctacgnggtccacgtggtctcccaggcctaggttcaggtcggcgtagggttcggggtctgggggactaggtagttccgtcttctctactactatacaggcacgtcctgacgtagtctaggtaaagtttagtttttaggttaccgggttttttaataccgtttagggtactaaacggtactaaaggttaattaaacgttccgtaacgggtttaccggtacccggttccgggtacggggttaacccgggtttccgggaaaccgggttaaacgggaaacccggtaaaaggggtacggtaaaacttaaaccggaaaacgttaaacgggttcggtacgggtaccttacggacccgttaacccg

SEQ ID NO: 331564 - DNA, 755 bp, Homo sapiens
  misc_feature: GZ8MTXP02JRS53.17.39.D06.1.454.CMB.2.raw
  modified_base (207)..(207): a, c, t, g, unknown or other
  misc_feature (207)..(207): n is a, c, g, or t
  modified_base (315)..(315): a, c, t, g, unknown or other
  misc_feature (315)..(315): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgtggcagctaacttgcctggtactcgagacaagaacctggcccaggcctcccgaggcctcctcattggtagtggtcnctactccgtacccgaggggccctaacgttcgggtccgtccccgacggtccccgtaggggtttccgagggttcgggaccgtaggggttcgggggtccgttagggggaaccttaggtcgtttcctccttactactacttactaacgtccgaacggtcccgtacgtcccgtaggtacccgtaggttaccgttaaggttaaacggtttagttttttacggggtaacccggttttttaattaccgttcgggttaccgaaggttaccgttaaaggtttaaaccttaaagttccggtaacgggttccgggtaccccgtttaccggggtagggtaccccgggtttaccgggaaaccggtaaaacggggtaaccgtaaagggggttaacgtaaaaccgtaaccggtaaaacggttacgtacgggtacggtaccgtacggacctaacccg

SEQ ID NO: 331565 - DNA, 536 bp, Homo sapiens
  misc_feature: GZ8MTXP02F1NZS.17.39.D06.1.454.CMB.2.raw
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (524)..(524): a, c, t, g, unknown or other
  misc_feature (524)..(524): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccacctgtctgtgtctccgaggggaaagagccaccctctcctgcagggccagtcagagtgttggcagcaacttagcctggtatcagcagaaacctggccaggcctcccaggcctccnatgtanggtncatctaccnggggcccagtggtctccagcccaggttcaggtgcagtggggtctggggacngagttcnctctcatcatcagcagcctgcagtcngaagtntttggacgtttatacttggtanacgtntaagtataatcgaggtcgcccttcggtaggaccgttcggaccgaaacgggtacctaaaggggtgaaaacgtaacgaaaacgtacgtagacggtacncggacctaaccg

SEQ ID NO: 331566 - DNA, 550 bp, Homo sapiens
  misc_feature: GZ8MTXP02HUKKV.17.39.D06.1.454.CMB.2.raw
  modified_base (203)..(203): a, c, t, g, unknown or other
  misc_feature (203)..(203): n is a, c, g, or t
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (466)..(466): a, c, t, g, unknown or other
  misc_feature (466)..(466): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttggcagcaacttagcctggtancagcagaacctggccaggctccaggctccncatgtatggtncatctaccagggccacgtggtcgtcccagcctaggttcaggttggcctagggtcgggggttctagggggactagggtagtttcctcgttctcaattccaatcagtccagtccctagcagtctaggaattagttttgtacggtttttatacgtgtacagctagtatatnagtcgctcgtggtacgtcggacgtaaacggaccgtaaagggtgaaaagtaacgaaaacgacgttaggcggactcggacctaacg

SEQ ID NO: 331567 - DNA, 553 bp, Homo sapiens
  misc_feature: GZ8MTXP02IKL8R.17.39.D06.1.454.CMB.2.raw
  modified_base (207)..(207): a, c, t, g, unknown or other
  misc_feature (207)..(207): n is a, c, g, or t
  modified_base (308)..(308): a, c, t, g, unknown or other
  misc_feature (308)..(308): n is a, c, g, or t
  modified_base (391)..(391): a, c, t, g, unknown or other
  misc_feature (391)..(391): n is a, c, g, or t
  modified_base (426)..(426): a, c, t, g, unknown or other
  misc_feature (426)..(426): n is a, c, g, or t
  modified_base (546)..(546): a, c, t, g, unknown or other
  misc_feature (546)..(546): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttggcagcaacttagcctggtatcagcaagaaacctggccaggcctcccaggcctcctcatgtatggtncattcctaccgaggggcccaacgtgggtcgtcccaggccctaggttcaggttggcaggtcggggtctggggacagtcgtttcnctctcatcatcagcagcctgcagtctagtaagttntttttgcggtttttaatacgttggtacagtctaagttaactatcgagtcggcccttcgggtcggtcgttacggcgaaaacggggaccaaagggttagaaaattcgaaaagacgtgcggcngtaccac

SEQ ID NO: 331568 - DNA, 557 bp, Homo sapiens
  misc_feature: GZ8MTXP02I73M7.17.39.D06.1.454.CMB.2.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (462)..(462): a, c, t, g, unknown or other
  misc_feature (462)..(462): n is a, c, g, or t
tcagcgtagactagcacgaccggtgctcgatttagtgacatctcgcagttcgtttggggggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccaccctctcctgcagggccagtcagngtgtggcagcaattgcctggtancagcagaaccnggccaggcctccaggcctcctnatgtatggtnctactccgaccgagggccctagtcggtcgtccccagcccgtaggttcgaggtggccgtagggtggggtcgtagggggactaggtacgttctctctacatcatcagcacgtcctagcagtctagtaagttgttttgtacgttttatacgtgtacagntagtataagtcgagtcgtcctcggtggtacgtcggacgaaacgggacgtaaggtagtaaacaacgaaacggtacgtcggcgtacgtcgactaacg

SEQ ID NO: 331569 - DNA, 557 bp, Homo sapiens
  misc_feature: GZ8MTXP02HV5XI.17.39.D06.1.454.CMB.2.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangcccacctntcctgcagggccagtcagngtgttggcagcaacttgcctggtatcagcaagaacctggaccaggcctcccgaggcctcctcatgtatggtncatctacgagggccagtggtcgtccagcctaggttcaggtgcaggtgggtctgggacngtagttcnctctcatcatcagcagcctgcagtctagaagttgtttgtcggtttttaatcgttgtacagtctaagttataagtcgagtcggtccttccggtagggtaccggttcggaccgtaaacgggggacctaaaggggtacggaaaactaacgaaaacggtacgtggtacggtaccgtacggactaaccg

SEQ ID NO: 331570 - DNA, 648 bp, Homo sapiens
  misc_feature: GZ8MTXP02IKO54.17.39.D06.1.454.CMB.2.raw
  modified_base (206)..(206): a, c, t, g, unknown or other
  misc_feature (206)..(206): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccacctgtctgtgtctccgaggggaaanagccaccctctcctgcaggccagtcagagtgtggcagcaacttagcctggtacncagacaagaacgnggaccaggcctccgagcctcctntatgtatggtcncatctaccgaggcctacgtggtccnccgacgtccgtaggtcgaggtggacgtagggtcggggtcgtaggacgtagtacgtttctcttctactatcgaactacgacgacgtacgtcgtcgtacgtacgtacgtagtaagtttagttttagtttacggttttacgtttacgttacgttacgtacgtacgtaagttaagttaacgttacgtacggtacggtaccggttaccggtacgggtaccggttaccggtaaccggtaaacgggtaaaccggtaaacggtaaacggtaaaacgtaaacgtaaaacggtaaacgtacggtacggtacgtacgtacgtaacg

SEQ ID NO: 331571 - DNA, 555 bp, Homo sapiens
  misc_feature: GZ8MTXP02HXE54.17.39.D06.1.454.CMB.2.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
  modified_base (418)..(418): a, c, t, g, unknown or other
  misc_feature (418)..(418): n is a, c, g, or t
tcagcgtagactagcacgaccggtgctcgatttagtgacatctcgcagttctttggggggggaggaactgctcagttaggacccagacggaaccatggaagcccccagcgcagcttctcttcctcctgctactctggctcccagataccactggagaagtagtgatgacgcagtctccagccaccctgtctgtgtctccgaggggaaangcccaccctntcctgcagggccagtcagngtgtggcagcaacttgcctggtatcagcagaacctggccaggcctcccgaggctccctcatgtatggtncatctaccgngggcccagtggcgtcccagccaggttcaggtggcngggtgggggtctgggggactaggtacgtttctctctcatcatcagcagcctgcagtctgtaagttnttttggacggtttttatacgtgtcagtctagttataatcgtagtcgggcccttcgggtcgggtaccggttccggaccgaaacggggaccgtaagggtacggaaactaaccgaaaacgtacgtggtggctgacctacg

SEQ ID NO: 331572 - DNA, 597 bp, Homo sapiens
  misc_feature: GZ8MTXP02I5DY6.17.39.D06.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctccgaggggaangccacctctcctgcagggccagtcagagtgtggcagcaacttagcctggtatcagcagaacctggaccaggcctcccgaggctccnatgtanggtncatcctacgngggccagtgcgtcccagcctagttcaggtgcgtaggtggggtcnggggactagtagttcnctctcatcatacgacgcagccctgctagtctagtaagttagttttggtacgttttattacgtgtacagtactaagtaattaacgtgtaacggtcgtacccgtaccgggttacgggttaacccggtttccgggaaaccggtaaacggggtaacccggtaaaagggttacggtaaaaacgtaaccggaaaaacgttacgtagggttacggacgttacggaaccttaaccg

SEQ ID NO: 331573 - DNA, 586 bp, Homo sapiens
  misc_feature: GZ8MTXP02GJ8JZ.17.39.D06.1.454.CMB.2.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagngtgtggcagcaacttgcctggtatcagcagaacctggccaggctcccaggctcctnatgtanggtgcatctaccgngggccagtggtctccagcctaggttcaggtgactagggtcggggtctggggactaggtagttctctctcatccatccagcacgccctagctaagtcgtagtaacgttagttttcgtacgggttttaatacgtggttaccaggtactaagttattaaacgtcgtaaggttcggcccgttcgggtacggtaccggtttccggaccggtaacgggaacccgtaacgggtagtaaacgtaaccgaaacgtaacgtaggtaggaccttcggactaaccg

SEQ ID NO: 331574 - DNA, 614 bp, Homo sapiens
  misc_feature: GZ8MTXP02ITLCH.17.39.D06.1.454.CMB.2.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccacctgtctgtgtctccgaggggaaangccacctntcctgcagggccagtcagagtgtggcagcaacttagcctggtatcagcaagaacctggaccaggcctccaggcctcctcatgtatggtnctatcctaccgngggccctacgttggtcgtcccagtcccaggtttcaggtggccgtagtggggtctaggggacaggtgttctcttctcattcatcagcacgctagcagttccgtagtaaagttagtttttaggacggtttttaatacgttggtaccgtaagtacgtaagttaacttaaagtcgtagggttcgacccgttccggtacggggttaccggtttccgggaaccggtaaacgggggtaaccgtaaagggtaacggtaaaacgtaaccggtaaaacggtaacgttcggtaacggtctacggtacctaacg

SEQ ID NO: 331575 - DNA, 529 bp, Homo sapiens
  misc_feature: GZ8MTXP02H3QJZ.17.39.D06.1.454.CMB.2.raw
  modified_base (206)..(206): a, c, t, g, unknown or other
  misc_feature (206)..(206): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (448)..(448): a, c, t, g, unknown or other
  misc_feature (448)..(448): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagagtgttggcagcaacttagcctggtatcagcagaacctggccaggctcccaggctcctnatgtatggtncatctaccgaggggcccacgtgggtctcccagcccgaggttcaggttggctaggtggggtctgggggacaggtacgttctcgtctcatcatcagcagcctgcagtctagtaacgttagtttttgacggtttttatacttggtcagntagtataatcagtcgacctcgtggtacgtcgacgaacggacaaggtgaaactaacgaaacgtacgtgtacgctcgactacg

SEQ ID NO: 331576 - DNA, 774 bp, Homo sapiens
  misc_feature: GZ8MTXP02JOE2U.17.39.D06.1.454.CMB.2.raw
  modified_base (205)..(205): a, c, t, g, unknown or other
  misc_feature (205)..(205): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgtggcagcacttgcctggtatcagcagaacctggccaggcctccgaggcctcctnatgtatggtncatccgtaccgagggcctagtcggtctccccgagtccctaggttcaggtggcgtagggtcggggtccgtgggggaacctagggtacgtttccgtccgttcctacgtattccgtaacgtccgaacggtccgacggtcccgtaggtacccgttaaggttaccgttaagggttaaaacggtttgttttttacggggtacccggtttttttaagttaacccgtttcggggttaaccaaggttaaccgttaaacggtttaagttaaacgttcggtaaacggggttccgggtacccccggtttccggggtttaaccgggggtacccgggttttaacccggggaaccccggggtaaaaccgggggtacccgggtaaaacgggggtttaacgggaaaaaacccgtttaacccgggtaaaaaaccggttaaaccgggttcgggtaaccgggtacccgttaacgggaaccccgtttaaaacccg

SEQ ID NO: 331577 - DNA, 792 bp, Homo sapiens
  misc_feature: GZ8MTXP02FPZS3.17.39.D06.1.454.CMB.2.raw
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
  modified_base (321)..(321): a, c, t, g, unknown or other
  misc_feature (321)..(321): n is a, c, g, or t
tcagcgtagactagcacgaccggtgctcgatttagtgacatctcgcagttctttggggaggaactgctcagttaggacccagacggaaccatgggagccccagcgcagcttctcttcctcctgctactctggctccagataccactggagaagtagtgatgacgcagtctccagccacctgtctgtgtctcgaggggaagngccaccctctcctgcagggccagtcagagtgttggcagctaacttagcctggtancagacagaaacctggacccaggcctacccgaggtcctcccgtctagttacggtagttcgggtacnctaacgtcccgtaaccggaacggggtccctaacggttcggggtaccgttacccccgaagggtccccgtaagggtttacgaacggggtttcgggaccgtaaggggtttcgggggtacccgttagggggaaacccttaggggttaccggttttacctccggtttacccgttaccttaagttccctaaacgttaccgtaacggtacccgaaaccggtccctttacgggacccgttaggttaccgtaaggttaaaagtttacggttttttcggtaaccgggttttttaactaacggtttcggttaacgtaacggtaccttaaaggtttaattaaacgtcggtaacgggttcggtaccgttaccggttacggggtaccggttaccgggaaccggtaaaacggggtaccgtaaaggggttacgtaaaacgtaacggtaaaacggaaccggtttgacggttactacggacttaacccg

SEQ ID NO: 331578 - DNA, 623 bp, Homo sapiens
  misc_feature: GZ8MTXP02IDRMD.17.39.D06.1.454.CMB.2.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (309)..(309): a, c, t, g, unknown or other
  misc_feature (309)..(309): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccacctgtctgtgtctccgaaggggaaangcccaccctcncctgcagggccagtcagagtgtggcagctaacttagcctggtatcagcaagaaacctggccaggcctccgaggcctcctcatgtatggtnctactctaccgagggcccagtggctccacgcctagggtcaggtggacgtaggtcgggtcgagggacctagttacgtttccacttccgtactatacactcagccgtaacgcccgttagaccgtagttctaaggtaacgtttagttttcggtacggtttttaatacgttcgtacgtagtagtaagttaataacgtacgtaggtcgtccgttccggtacggttaccggttacggaaccgggtaaacgggaaccgtaaagggtaacgtaaaacgtaaccgtaaaacggtaacgtcgggtaacgtcgtacgtacctacg

SEQ ID NO: 331579 - DNA, 739 bp, Homo sapiens
  misc_feature: GZ8MTXP02HDNAN.17.39.D06.1.454.CMB.2.raw
tcagcgtagactagcacgaccggtgctcgatttagtgacatctcgcagttctttggggtctgggagaggagcccagcactagaagtcggcggtgtttccattcggtgatcagctctgagcacagaggactcaccatggagtttgggctgagcttgggttttcctcgtcgcttcttttcagaggtgtccagtgtcaggtgcagctgggtggagtcgtgggggagcgtggtccagccgtgggacgtcctgagctctcctgtgcagcgtctggacttccaccttcaagttaactagtggactagtcgcacgtcggggtccccgccgaggccctaccggagggaccggaaagggggctaggggaggtcggggtaggtcgtaaggtttagtgggttaggtattgggaagttaggggtaaaattaagttaaccgtaaatttacgttaagttacggttaaacggtaacccgtttccgggtaaggggtaaaccggggtcccgttaaacgtttacccgaaccctaacgttacccgtaacccgaaggtaaacgtaaacccttaaaaccgtttaccccgaaaacggtaaaccccgtaccgggttacccttaggttaaaccttacgtaacggtaaaccctaaaagtacgaaaaccgtacggtacccgtaggaaacggtacggtacggaaacggtaccgacggtcgtaggtaacgtaacgtacgtggtaggaccggtaggtacggtttacgg

SEQ ID NO: 331580 - DNA, 662 bp, Homo sapiens
  misc_feature: GZ8MTXP02FNTWI.17.39.D06.1.454.CMB.2.raw
  modified_base (203)..(203): a, c, t, g, unknown or other
  misc_feature (203)..(203): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctccgaggggaanacgccaccctctcctgcagggccagtcagtagtgtggcagcaatgcctggtancagcagaacngccagctccagctctnatgtatggncatcctacgngggtccatggtcnccagccgtaggttcaggtgcgtagggtggggtctagggggactaggtagtttcctacgtcctactactcctagtccaggtctacggccctaggtaccctaggtacctaggtaaagtttgtttttacggtccggtttttaattacgttacgggtacctaacgggtacttaaaggtttaacttaacgttccggtaacgggttcccgggttccccggtttaccggggtacggggtttaaaccggggttacccggggaaccggtaaaacgggggtacccgtaaaagggggtacgtaaaactaaccggtaaaaaccggttacgtgggtaccggtactacggaccgttaaaccg

SEQ ID NO: 331581 - DNA, 555 bp, Homo sapiens
  misc_feature: GZ8MTXP02I40J3.17.39.D06.1.454.CMB.2.raw
  modified_base (259)..(259): a, c, t, g, unknown or other
  misc_feature (259)..(259): n is a, c, g, or t
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagcccaccctctcctgcagggccagtcagagtgttggcagcaacttagcctggtancagcagaacctggccaggcctcccaggcctcctcatgtatggtncatcctaccgagggccagttggcgtcccagccaggttcagtggcagggtggggtctggggacagtacgttcnctactcatcatcgagcagtcctgctagtactgtaagttagtttttggtacggtttttattacgttgttaccgagtactaagttataaagtcgagtcggtcctcggtggtaccgttcggacgtaacggggacgacgggtaggaaactaacgtaaacgtaacgtggtagactcggactaacg

SEQ ID NO: 331582 - DNA, 624 bp, Homo sapiens
  misc_feature: GZ8MTXP02G8F2P.17.39.D06.1.454.CMB.2.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctntcctggcagggccagtcagagtgttggcagctaacttagcctggtatcagcagaacctggccaggctccaggctctcntgtatggtnctactccgtaccgagggcccagtcggtcgtcccacggtccaggttcaggttgacgtaggtcgggggttactgggggaacctagggtacgttcctcgtctacagtacatcagctacgcctgccgtagtctagaaacgttgtttacgtacggtttatacgtgtacacgtataagttaataacgtcgtaacggtttcgacccgtttcggcgggttaccgggttaccgaacccggaaacgggggtaccctaagggggtaaaccgtaaacgtaaaccggtaaacggtaaacgttcgggtaacgaccgttccggaacttacccgg

SEQ ID NO: 331583 - DNA, 623 bp, Homo sapiens
  misc_feature: GZ8MTXP02I5VFZ.17.39.D06.1.454.CMB.2.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttggnagcaacttagcctggtatcagcagaacctggccaggcctcccgaggcctcctcatgtatggtgcactccgtaccgagggccctacgtggtcgtcccagccaggttcaggtggctaggtggggtctgggactaggtagtttcctcgtctcctagtccagtcagtccgacgcccgtgacctagttcgtaggtaaacgttagtttttcggtaccggtttttatacgttggtacaggtacttaaggtattaacgtcgtaaggtcgtcccgttacgggtcggggtacccgtttccggaaccggtaaaacggggacccgttaaaagggtacggaaaactaaccgaaaaacggtacgttacgggtcggtactacggacctaaccg

SEQ ID NO: 331584 - DNA, 583 bp, Homo sapiens
  misc_feature: GZ8MTXP02IAEEJ.17.39.D06.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (427)..(427): a, c, t, g, unknown or other
  misc_feature (427)..(427): n is a, c, g, or t
  modified_base (466)..(466): a, c, t, g, unknown or other
  misc_feature (466)..(466): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccaccctctcctgcagggccattcagagtgtggcagctaacttagcctaggtatcagacagaaacctggccaggcctccaggctcctnagtgtagtggtgcacttcaccgaggccagtcggctaccacgccctaggttcagtcggactagggtgggtctggggactagtcggttctctctactagtccatcacgctacgccttaggctagtctagtaaagttnttttggtacggttttatacgttgtacagtcgtagttaanaactgtaggtcgtccgttacggtcggttaccgggttccggacggaaacggggtaccgaaagggttacggaaaacgttaacgaaaacggtaacgttacgacggtactacgacctaccg

SEQ ID NO: 331585 - DNA, 683 bp, Homo sapiens
  misc_feature: GZ8MTXP02I0GKB.17.39.D06.1.454.CMB.2.raw
  modified_base (280)..(280): a, c, t, g, unknown or other
  misc_feature (280)..(280): n is a, c, g, or t
  modified_base (360)..(360): a, c, t, g, unknown or other
  misc_feature (360)..(360): n is a, c, g, or t
tcagcgtagactagcacgaccggtgctcgatttagtgacatctcgcagttctttggggtctgggagaggagcccagcactagaagtcggcggtgtttccattcggtgatcagctctgagcacagaggactcaccatggagtttgggctgagctgggttttcctcgtcgctcttttcagaggtgtccagtgtcaggtgcagctggtggagtcgtgggggagcgtggtccagcctaggacggtccctgacgactctcctgtgcagcgtctggattcaccttnagtactatggcagtgctacgtcggggtcccgccgacggtccctcccgagggccgaaagggggctaggggaggttcggggnggctaggttagtggttaggtatggagttagggtaaagttaactcaaattactagttacgtaagtacttcccggtaggaaacggggtcccgtaatttacccgaacctacttaccgtacccgaagtaacgaaacctaaacgtttaacccccgtaaaagaaacccgtaacggtacccttaggttaacttaccgttacgaaacctaaaagttagaaaaccgtaacgtcccgtaggaaacggtacggttaccggaaacggtaaccgtaccggggtctttacggtaacgttactacggttcggtaggacggtaaggtacggtttaccgg

SEQ ID NO: 331586 - DNA, 596 bp, Homo sapiens
  misc_feature: GZ8MTXP02IOJK2.17.39.D06.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaagngccaccctctcctgcaggggccagtcagagtgttggcagcaacttagcctggtatcagcagaacctggccaggctccccaggcctcnatgtatggngcatcctacgacggccacgtggtcgtcccacgccgtaggttcaggttggcgtagggttcgggggtcgtagggggacctaggtgtttctcgtctcatccatcagcagccctgctagtcgtagaaagtttgttttcggtacggtttttattacgttggtacctagtaccgtaagttaattaaactcgtaggtccgggtccgttccgggttagggaccggttcgggaacccgtaaaagggggccgtaaaaggggtacgtaaaactaaccggaaaacgacgttggacgtcgtacgaccaac

SEQ ID NO: 331587 - DNA, 687 bp, Homo sapiens
  misc_feature: GZ8MTXP02IDB0D.17.39.D06.1.454.CMB.2.raw
  modified_base (209)..(209): a, c, t, g, unknown or other
  misc_feature (209)..(209): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggcctcccagataccactggagaagtagtgatgacgcagtctccagccacctgtctgtgtctccgaaggggaaancgcccacctctcctgcgaggccagtcagagtgtggcagcaacttgcctggtancagcaagaacctggaccaggcctccgaggcctcctnatgtatggncatcaccgnggcctagtggtctccagccgtaggttcaggtggctagggtcgggtcgtggggactaggttacgtttcctcgttcctacgtacttacgaacgttccaacggtccctaacggtccccgttggtaccctagggtttccgttaaggtaaaaggtttttcggtttttttacggttacggggtttttttaaacttaccggtttggtaccgtaacgtacgttaaaggtttactaacgttacgtacggtttcggcccgtttacgggtacggggtaccggtttaccggaccgggtaaaacggggtaaccgtaaacggggtaagtaaaactaaccggaaaacggtaacgttacgggtacggtccgtacgtaccgtaacccg

SEQ ID NO: 331588 - DNA, 537 bp, Homo sapiens
  misc_feature: GZ8MTXP02GF4VI.17.39.D06.1.454.CMB.2.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (279)..(280): a, c, t, g, unknown or other
  misc_feature (279)..(280): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
  modified_base (431)..(431): a, c, t, g, unknown or other
  misc_feature (431)..(431): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagngtgtgcagcaattgctggancancagaaccngccagctccagctcnntgtatggtncatcacgagggccagtggtctccagcctaggttcaggtgcnggtgggtcngggacagtgttcnctcnatcatcagcagcctgccagttacaggtaaagttnttttggtacggttttaataccgtggtacaagtcaagttaanaacgtcgtaggtcgcccgttcggtgggtaaccggttcggaccggtaaacgggaccgtaaaaggggtcgaaaacgtaacgaaacgtaacgtgcggactgacctaacg

SEQ ID NO: 331589 - DNA, 547 bp, Homo sapiens
  misc_feature: GZ8MTXP02GMB7Y.17.39.D06.1.454.CMB.2.raw
  modified_base (208)..(208): a, c, t, g, unknown or other
  misc_feature (208)..(208): n is a, c, g, or t
  modified_base (317)..(317): a, c, t, g, unknown or other
  misc_feature (317)..(317): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttggcagcaacttagcctggtatcagcagaacctggccaggctcccaggctcctcatgtatggtgcatcctaccgngggccacgtggtctcccagcccaggttcaggtggcgtaggtcggggtctgggggactaggtacgtttctctctcatcatcagcagcctgctagtctaggtaacttagttttgtacggttttatacgtgtacagtctaagtataatcaggtcgtctcggtggtacgttcgggacgaacggggtaccaagggtagaaactaacgaaaacggactcggtcgctcgactaaccg

SEQ ID NO: 331590 - DNA, 756 bp, Homo sapiens
  misc_feature: GZ8MTXP02HV3F5.17.39.D06.1.454.CMB.2.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
tcagcgtagactagcacgaccggtgctcgatttagtgacatctcgcagttctttggggggggaggaactgctcagttaggacccagacggaaccatggaagcccccagcgcagcttctcttcctcctgctactctggctcccagataccactggagaagtagtgatgacgcagtctccagccaccctgtctgtgtctccgaggggaaancgccaccctctcctgcagggccagtcagagtgttggcagcaacttagcctggtatcagcaagaacctggccaggcctccgaggctcctcatgtatggtnctatccgtaaccgacggggtccacgttcgggtcgtaccccgaggtccccgtaggttcagggttgggccgtaggggttcgggggttcgtagggggacctagggttacgtttcctaccttccgtacctatttacccaagttcccgaagggtaccctaacggtcccccgttggacccgtaggttaccgttaagggtaaaacggttttgttttttacggggtacgggtttttttaaatacccggttgggttaccaaggtaccgttaaaggtttaacttaaacgttccggtaagggttccgggtaaccccctttccgggggttagggttaacccccgggtttacggggaaacccggtaaaacgggggtaccccgtaaaagggggttaaacgaaaacgttaaaccggaaaaaccggttcggtacgggtacggaccttacgggacccttaaaccg

SEQ ID NO: 331591 - DNA, 492 bp, Homo sapiens
  misc_feature: GZ8MTXP02HBX5Y.17.39.D06.1.454.CMB.2.raw
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (482)..(482): a, c, t, g, unknown or other
  misc_feature (482)..(482): n is a, c, g, or t
tcagcgtagactagcacgaccggtgctcgatttagtgacatctcgcagttctttgggggggaggaactgctcagttaggacccagacggaaccatggaagccccagcgcagcttctcttcctcctgctactctggctcccagataccatggagaagtagtgatgacgcagtctccagcccacctgtctgtgtctccgaaggggaaancgcccacctctcctgcagggccagtcagagtgtggcagcaacttgctggtatcagcagaacctggccaggctccaggctcctnatgtatggncatccgtacgngggccagtggntccagccaggtcagtgcaggtgggtcngggacagtcgttcnctctcatcatcagcagcctgctagtctagagttattttgacgttttatacgtgtacngtanagttataatcgagtcgctcgtgacgtcggacacggtacagtcgagaagtacacaaacgncgtcgctacg

SEQ ID NO: 331592 - DNA, 644 bp, Homo sapiens
  misc_feature: GZ8MTXP02FT1X0.17.39.D06.1.454.CMB.2.raw
  modified_base (207)..(207): a, c, t, g, unknown or other
  misc_feature (207)..(207): n is a, c, g, or t
  modified_base (509)..(509): a, c, t, g, unknown or other
  misc_feature (509)..(509): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccacctgtctgtgtctccgaggggaaangccaccctctcctgcagggccagtcagagtgttggcagcaacttagcctggtatcagcagaacctggccaggcctcccaggcctcctcatgtagtggtgctatccgtaccgaggggtccctagtcggtcgtcccgacgtcccgtaggttcagggttcggaccgtaggggttcgggggtcctagggggaacctaggtacgtttcgtctcgtctaatccaatccgagcctacgcccgttgacctaggtactaggtaagtttattttggtacggttttatacgtgtactagcttaagtattacgngtaggtccggtaccgttacggtcgggtaccggttccgggaaaccggaaacgggggtaaccgtaaaagggggtacgtaaaaacgttaacggaaaaccgtacggtttagggacggttacgtacggaacccttaaccg

SEQ ID NO: 331593 - DNA, 748 bp, Homo sapiens
  misc_feature: GZ8MTXP02JKNIO.17.39.D06.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccaccctctcctgcagggccagtcagagtgttggcagctaacttagcctggtatcagcagaacctggccaggcctccaggctcctnatgtatggtgcagtcctaccgaggggtcccacgtggtcgtccccaggtcctagggtttccaagggttcgggaccgtagggttcgggggtaccgtgggggaccgtaaggtcgtttctcgtacttcattcgactcgagaccgacgtcccgtaggtcccaaggttccctaagggtaaacgttacggttttttacgggaccggttttttttaaacgtaacccgtttggttaccccgtaaaggttcccgttaaagggttaaaccgttaaaacttcccggtaaaggggtttaccggggtcccccgtttaccgggggtttacgggttaaccccgggttacccgggggtaaacccgggaaaacgggggttaaacccccgtaaaaagggggttaccggaaaaaacgttaacccggaaaaaaccggtaaccgttaggggtacgggtacctaccgggaccttaaacccg

SEQ ID NO: 331594 - DNA, 617 bp, Homo sapiens
  misc_feature: GZ8MTXP02FYM11.17.39.D06.1.454.CMB.2.raw
  modified_base (208)..(208): a, c, t, g, unknown or other
  misc_feature (208)..(208): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgtggcagctaactncctggtatcngacagaaacctggaccaggcctcccgaggcctcctctagtgtagtggtcgctatcctaccgacggggtcctacgtggtcgtcccgaacgtcccgtaggttcaggttcggacgtagggtcgggggtactgggggaactagggtacgtttctcgtctatatcatcagtccagcctgctagtctagtaagttgtttaggtcggtttatcgttgtacacgtacttagtaactaacgtgtaacgtcgtaccgtcgggttaacggtccggttacggaaccggtaaacgggtaaccgtaaggtaacggtaaaacgtaaccgtaaaaacggcgttacggtacgtacgttacgacctaaccg

SEQ ID NO: 331595 - DNA, 607 bp, Homo sapiens
  misc_feature: GZ8MTXP02F2BLX.17.39.D06.1.454.CMB.2.raw
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtcctgtgtctccgaggggaagagccaccctctcctgcagggccagtcagagtgttggcagcaacttagcctggtatcagcagaacctggccaggcctccccgaggctccncatcgtatggtncatctaccgngggtccacgtggtcgtcccagtccaggttcaggtggcgaggtcgggtctggggactaggtacgttctcgtctanattccatcgagccgtaggcccttagctagtcctagtaagttattttgggacgtttttataccttgtacagtactaagttactaatcgaggttcggtacccgttacggtagggtacccggtttcgggaacccggttaaagggacccgtaaaagggtacgggtaaaactaaccggtaaaaacgtacgttacggtacggtcctaacggctaaacccg

SEQ ID NO: 331596 - DNA, 681 bp, Homo sapiens
  misc_feature: GZ8MTXP02IB0DB.17.39.D06.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (315)..(315): a, c, t, g, unknown or other
  misc_feature (315)..(315): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagatgccatggagaagtagtgatgacgcagtctccagccacctgtctgtgtctcgaaggggaaancgccacctntcctgcagggccagtcagtagtgtgcagctaattgcctggtatcgagcaacgaaaccgtcggaccacggtcctcccgaggcccttcctacgatcgtagtcggtnactagtaccgtacgacggcctagtcgggtacctacccccgagtaccgtaggttccaagggttcgggcgtggggtcggggttactaggggtacctaaggttcgtttctcccgtctttacgaatttcaacgtcgacgtacgacgtccgttagccgtagttaccgtaaggttaaacgtttggtttttacggtttacgggtttaactttacgtggtttaccaacgtacgtaacgtttaataacgttcgtaaacgggttcgtcccgtacggggttacggtaccggtttacggacccggttaaagggaacgtaaacggggtacgaaaacgtccgtaaaaaggtccgtaggttacggacgtttacgaaccccg

SEQ ID NO: 331597 - DNA, 643 bp, Homo sapiens
  misc_feature: GZ8MTXP02F6H7H.17.39.D06.1.454.CMB.2.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
  modified_base (612)..(612): a, c, t, g, unknown or other
  misc_feature (612)..(612): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccaccctctcctgcagggccagtcagngtgtggcagctaacttgctggtatcagcaagaaccgtggaccaggcctccccgaggtcctccctnattgtagtggtcnctactcccgtacccggaggggtacccctacggttcgggtaccgttacccccgaacggtcccccgtaaggggtttcccgaaggggttccggggaccgtaaggggtttcgggggtacccgtagggggaacctacggggttacgtttcctcttcctactatcctaatcgagccgtacgccttgactggtactagtaaagtttgtttcggtacggttttaatcgtcgtacagtacgtagtactacgtcgagtccgtccgtcggtaggccgttacggaccgtaacgggacctaacgggtagtaaacncgtaaaacgcgttggacgtctacggactacg

SEQ ID NO: 331598 - DNA, 556 bp, Homo sapiens
  misc_feature: GZ8MTXP02HJ429.17.39.D06.1.454.CMB.2.raw
  modified_base (203)..(203): a, c, t, g, unknown or other
  misc_feature (203)..(203): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcaagaacctggccaggctccaggcctcctcatgtatggtgcatcctacgagggccacgtggtcgtcccagccctaggttcaggtggctaggtgggggtctggggacaggtacgtttctctctcatcatcagcagcctgcagtcngtaagtntttttggacggtttttataccgtgtacagtactaagttactaatcgtagtcggcccgttcggaggttaccgttccggacggaacgggtaaccgaagggtaggaaaactaaccgaaaacggaacgttggaggtactcgacgtaac

SEQ ID NO: 331599 - DNA, 600 bp, Homo sapiens
  misc_feature: GZ8MTXP02JFOII.17.39.D06.1.454.CMB.2.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctccagataccactggagaagtagtgatgacgcagtctccagccacctgtctgtgtctccgaggggaaangccacctctcctgcagggccagtcagngtgtggcagctaatgcctggtancagcaagaaccnggaccaggcctcccaggtcctccnatgtatggngcatccgtacgagggccctagtcggtctcccagcccgtaggtcaggtgcgagggtggggtctggggacctagtacgtttctcgtctactatcatcgagccgaacgtccgtaggtacctagttcgttaagtaaggtttagttttacgggtacggttttaatttacgttacgggtactagacgttaaggtaattaacgtcgtagtcggtcccgtcggtacgggtacggttcgggaaccgaaacggggtaccgtaaaggtaacggaaactaacgaaacggtaacgtcggtagcgtacgacgtaacc

SEQ ID NO: 331600 - DNA, 583 bp, Homo sapiens
  misc_feature: GZ8MTXP02GW8VA.17.39.D06.1.454.CMB.2.raw
  modified_base (208)..(208): a, c, t, g, unknown or other
  misc_feature (208)..(208): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttggcagcaacttgcctggtatcagcagaacctggccaggctccaggctccncatgtatggtgcatcctaccgngggcccacgtggtcgtcccagcccgtaggttcaggtcggctaggtggggtcctgggggaccaggtacgttcctcgtctcatcatcagcagcctgctagtctagtaacgttagttttgcggtttttatacgttggtccaagtcgtaagttaattaaacgtcgtaagtcggtcccttacggtcggtaccgtttacgggaaccgaaacggggtaccgtaaagggtaggaaaactaacgaaaaacggtacgttggacggtctacgaccgtaacg

SEQ ID NO: 331601 - DNA, 713 bp, Homo sapiens
  misc_feature: GZ8MTXP02JOOYR.17.39.D06.1.454.CMB.2.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
tcagcgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttggcagctaacgttgcctggtatcagcaagaacctggccacggcctccaggctccncatgtatggncatctaccgaggccagtcggtcgtccacggtccaggttcaggtcgcgngggttcggggtntaggggacgtagtacggtttccctcttcctcgtactaccgtactccgaacggtccctaacggtccccgtggacccgttaagtacgttagggtaaaacggtttcggttttttacgggtaccggtttttaaagttccggttacggttaaccgagggttacctaaaacggggtttaattaaacgttacgtaaacggggttccggtcccccggtttacggggttaccggggttaccgggtttacccgggaaccggggtaaaaccggggtacccgtaaaaagggggtaccgtaaaaacgtaaccgaaaaacggttacggtacgggttagggacccgttacggaacctaccg

SEQ ID NO: 331602 - DNA, 696 bp, Homo sapiens
  misc_feature: GZ8MTXP02FPMJX.17.39.D06.1.454.CMB.2.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (315)..(315): a, c, t, g, unknown or other
  misc_feature (315)..(315): n is a, c, g, or t
tcagcgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccacctgtctgtgtctcgaggggaaangccacctctccngcagggccagtcagtagtgttggcagctaacttagcctggtatcgagacaagaaaccgtggaccaaggcctccgaaggcctcctacagttgtaatcggtanactactacccgtaaccggacggtacctagtcggtaccgtacccgacggtaccgtaaggtcgacgggtcggacgtagggttcggggtacgtacggggtaacgtacggttcgtttacctcgttacctactactacgagtacgagtacgacgcctagacgtagtactaggttaaacgtttgttttaacgggtacgttttaactacgttacggtaactaagttacgtaaagttaactaagtacggtacggtcggttaccccgttacgggttaacgggtaccggttaccgggaaaaccgggtaaaacgggtaaacggtaaacggtaaacgtaaaactaaaccggtaaaacggtacgtacgggtacgtaccgtacgtacccgtaacg

SEQ ID NO: 331603 - DNA, 506 bp, Homo sapiens
  misc_feature: GZ8MTXP01A64GV.21.81.H04.1.454.CMB.2.raw
  modified_base (266)..(266): a, c, t, g, unknown or other
  misc_feature (266)..(266): n is a, c, g, or t
  modified_base (357)..(357): a, c, t, g, unknown or other
  misc_feature (357)..(357): n is a, c, g, or t
  modified_base (436)..(436): a, c, t, g, unknown or other
  misc_feature (436)..(436): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtcttttatgactatgtctctggtacaacaanacccagcaaagccccaaatcatcatttatgatgtcagtaatcggccctcagggggtttctaatcgcttctctcgctcaagtctggacaacncggcctccctgaccatctctgggctccaggctgatgacgagctgattatactgcaggggtcatatacaatcagcaaacnttatgtcttgggaactgggaaccagactcaacgttcgttaggcaagccaacgccaacccacgtgttcaac

SEQ ID NO: 331604 - DNA, 512 bp, Homo sapiens
  misc_feature: GZ8MTXP01BBNCQ.21.81.H04.1.454.CMB.2.raw
  modified_base (365)..(365): a, c, t, g, unknown or other
  misc_feature (365)..(365): n is a, c, g, or t
  modified_base (478)..(478): a, c, t, g, unknown or other
  misc_feature (478)..(478): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaaagcccccaaaactcatcatttatgatgtcagtaatcggccctcagggggtttctaattcgcttctctcggctcaagtctggacaacncggcctccctgaccatctctggctcaggctgatgacgaggctgattatactgcagggtcatatacaatcagcaacacttatgtcttgggaactgggaccaagatcaacgttcnggttcaagcccaaggcccaacccactgttctaac

SEQ ID NO: 331605 - DNA, 523 bp, Homo sapiens
  misc_feature: GZ8MTXP01D9I8O.21.81.H04.1.454.CMB.2.raw
  modified_base (244)..(244): a, c, t, g, unknown or other
  misc_feature (244)..(244): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttttangactatgtctcctggtaccaacaatacccaggcaaagcccccaaaactcatcatttatgatgtcagtaatcggccctcagggggtttctaatcgcttctctggctcaagtctggacaacncggcctccctgaccatctctgggctcaggctgatgacgaggctgattatactgcaggggtcatatacaaatcagcaaactcttaatgtcttcgggaacttgggaccaagactcaccgttcttggttcaagaccccaaggcccaaccccactgcctaacc

SEQ ID NO: 331606 - DNA, 513 bp, Homo sapiens
  misc_feature: GZ8MTXP01EROTT.21.81.H04.1.454.CMB.2.raw
  modified_base (362)..(362): a, c, t, g, unknown or other
  misc_feature (362)..(362): n is a, c, g, or t
  modified_base (440)..(440): a, c, t, g, unknown or other
  misc_feature (440)..(440): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcagggggtttctaatcgcttctctcggctcaagtctggcaacncggccctccctgaccatctctgggctcaggctgatgacgaggctgattattactgcaggggtcatatacatcagcaancttatgtcttggaactgggaccaagatcacgttcttggttcaacgcccaaggcccaacccactcgttctaacc

SEQ ID NO: 331607 - DNA, 518 bp, Homo sapiens
  misc_feature: GZ8MTXP01EB84A.21.81.H04.1.454.CMB.2.raw
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (363)..(363): a, c, t, g, unknown or other
  misc_feature (363)..(363): n is a, c, g, or t
  modified_base (443)..(443): a, c, t, g, unknown or other
  misc_feature (443)..(443): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttttangactatgtctcctggtaccaacaanaccccaggcaaagcccccaaaactcatcatttatgatgtcagtaatcggccctcagggggtttctaatcgcttctctggctcaagtctggcaacncggcctccctgaccatctctgggctccaggctgatgacgaggctgattatactgcaggggtcatatacaatcagcaaacncttaatgtcttgggaacttgggaccaaagatcacgttcaggttcaagcccaacggccaacccactcgttctaacc

SEQ ID NO: 331608 - DNA, 528 bp, Homo sapiens
  misc_feature: GZ8MTXP01B3VW4.21.81.H04.1.454.CMB.2.raw
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaagcccccaaaactcatcatttatgatgtcagtaatcggccctcagggggtttctaatcgcttctctcggctcaagtctggcaacncggcctccctgacccatctctgggctccaggctgatgacgaggctgattattactgcaggggtcatatacaaattcagcaaacactttatacgtcttcgggaactggggaccaagactcaccgttcttaggttcaagcccaaggcccaacccactcgttcaacc

SEQ ID NO: 331609 - DNA, 545 bp, Homo sapiens
  misc_feature: GZ8MTXP01EEDR2.21.81.H04.1.454.CMB.2.raw
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctgtacaacaanacccaggcaaacgccccaaactcatcatttangatgtcagtaatcggccctcgtaggggtttctaatcgcttctctcggctcaagtctggacaacncggcctccctgaccatctctcgggctccgaggctgatgacgaggctgattatactgcaggggtcaatatacaatcatacaaactacttatgttcgttcggggaacttggggaaccaaaggttactcgacccgttcgttagggccaacgacccgaacggccccaaaccccactcgttcctaacccg

SEQ ID NO: 331610 - DNA, 517 bp, Homo sapiens
  misc_feature: GZ8MTXP01BP0VV.21.81.H04.1.454.CMB.2.raw
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (365)..(365): a, c, t, g, unknown or other
  misc_feature (365)..(365): n is a, c, g, or t
  modified_base (444)..(444): a, c, t, g, unknown or other
  misc_feature (444)..(444): n is a, c, g, or t
  modified_base (468)..(468): a, c, t, g, unknown or other
  misc_feature (468)..(468): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtacaacaanacccaggcaaacgcccccaaactcatcatttatgatgtcagtaatcggcccttcgaggggttttctaatcgcttctctcggctcaagtctggacaacncggcctccctgaccatctctgggctcaggctgatgacgagctgattattactgcaggggtcatatacaatcaagcaacnttatgtctcgggaatgggacaagntcacgttccgttggttcaagcccaaggcccaaacccgctcgttctaacc

SEQ ID NO: 331611 - DNA, 510 bp, Homo sapiens
  misc_feature: GZ8MTXP01B1SX6.21.81.H04.1.454.CMB.2.raw
  modified_base (242)..(242): a, c, t, g, unknown or other
  misc_feature (242)..(242): n is a, c, g, or t
  modified_base (358)..(358): a, c, t, g, unknown or other
  misc_feature (358)..(358): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtacaacaatacccaggcaaagccccaaactcatcatttatgatgtcagtaatcggccctcaggggtttctaatcgcttctctcggctcaagtctggacaacncggcctccctgaccatctctcgggctcaggctgatgacgagctgattatactgcaggggtcatatacaatcagcaacacttatgtcttgggaactgggacaagatcaccgttccttaggcaacgcccaaggcccaacccgctcgttctaacc

SEQ ID NO: 331612 - DNA, 527 bp, Homo sapiens
  misc_feature: GZ8MTXP01AP5LF.21.81.H04.1.454.CMB.2.raw
  modified_base (365)..(365): a, c, t, g, unknown or other
  misc_feature (365)..(365): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaacgcccccaaaactcatcatttatgatgtcagtaatcggccctcagggggttttctaatcgcttctctcggctcaagtctggacaacncggccctccctgacccatctctgggctccaggctgatgacgaggctgattattactgcaggggtcaatatacaaatcaagcaaacacttatgtctgggaactggggaccaagatcaccgttcgttaggttcaagcccaaggccccaacccactcgttcaacc

SEQ ID NO: 331613 - DNA, 543 bp, Homo sapiens
  misc_feature: GZ8MTXP01A63GH.21.81.H04.1.454.CMB.2.raw
  modified_base (242)..(242): a, c, t, g, unknown or other
  misc_feature (242)..(242): n is a, c, g, or t
  modified_base (363)..(363): a, c, t, g, unknown or other
  misc_feature (363)..(363): n is a, c, g, or t
  modified_base (415)..(415): a, c, t, g, unknown or other
  misc_feature (415)..(415): n is a, c, g, or t
  modified_base (477)..(477): a, c, t, g, unknown or other
  misc_feature (477)..(477): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaagcccccaaaactcatcatttatgatgtcagtaatcggccctcagggggtttctaatcgcttctctcggctcaagtctggcaacncggcctccctgaccatctctgggctcaggctgatgacgaggctgattatacngcaggggtcatatacaatcagcaaactcttaatcgtcttcggggaacttggggaccaaaggntccgaaccgttccgttagggttccaaggccccaaagggccccaaaccccgactaacgttctaaccc

SEQ ID NO: 331614 - DNA, 509 bp, Homo sapiens
  misc_feature: GZ8MTXP01AX1IR.21.81.H04.1.454.CMB.2.raw
  modified_base (364)..(364): a, c, t, g, unknown or other
  misc_feature (364)..(364): n is a, c, g, or t
  modified_base (445)..(445): a, c, t, g, unknown or other
  misc_feature (445)..(445): n is a, c, g, or t
  modified_base (489)..(489): a, c, t, g, unknown or other
  misc_feature (489)..(489): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaaactcatcatttatgatgtcagtaatcggccctcagggggtttctaatcgcttctctcggctcaagtctggacaacncggcctccctgaccatctctgggctccaggctgatgacgaggctgattattactgcaggggtcatatacaatcagcaaacncttatgtcttcgggaactgggaccagatcacgttcttaggcaancccaagccacccatgctaac

SEQ ID NO: 331615 - DNA, 527 bp, Homo sapiens
  misc_feature: GZ8MTXP01DZQ2E.21.81.H04.1.454.CMB.2.raw
  modified_base (362)..(362): a, c, t, g, unknown or other
  misc_feature (362)..(362): n is a, c, g, or t
  modified_base (442)..(442): a, c, t, g, unknown or other
  misc_feature (442)..(442): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcagggggtttctaatcgcttctctcggctcaagtctggacaacncggcctccctgaccatctctgggctccaggctgatgacgaggctgattatactgcaggggtcatatacaatcagcaaacncttatgtcttcggggaacttgggaccaagataccaccgttccgttaggttcaacgcccaacggcccaccccgatcgttcctaacc

SEQ ID NO: 331616 - DNA, 513 bp, Homo sapiens
  misc_feature: GZ8MTXP01CXLM2.21.81.H04.1.454.CMB.2.raw
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
  modified_base (476)..(476): a, c, t, g, unknown or other
  misc_feature (476)..(476): n is a, c, g, or t
  modified_base (505)..(505): a, c, t, g, unknown or other
  misc_feature (505)..(505): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctctagggggtttctaatcgcttctctcggctcaagtctggacaacncggccctccctgaccatctctgggctcgaggctgatgacgaggctagattatactgcaggggtcatatacaatcagcaaactcttatgtctcgggaactgggaccaagctcncgttcaggttcaagcccaaggccaacccntcgctaac

SEQ ID NO: 331617 - DNA, 511 bp, Homo sapiens
  misc_feature: GZ8MTXP01DO6GQ.21.81.H04.1.454.CMB.2.raw
  modified_base (362)..(362): a, c, t, g, unknown or other
  misc_feature (362)..(362): n is a, c, g, or t
  modified_base (442)..(442): a, c, t, g, unknown or other
  misc_feature (442)..(442): n is a, c, g, or t
  modified_base (503)..(503): a, c, t, g, unknown or other
  misc_feature (503)..(503): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaaactcatcatttatgatgtcagtaatcggccctcagggggtttctaatcgcttctctggctcaagtctggcaacncggcctccctgaccatctctgggctccaggctgatgacgaggctgattatactgcaggggtcatatacaatcagcaaacncttatgtcttcgggaatgggaccaagatcacgttcttggttcaagcccaaggcccaacccnctgctaac

SEQ ID NO: 331618 - DNA, 508 bp, Homo sapiens
  misc_feature: GZ8MTXP01DSAOX.21.81.H04.1.454.CMB.2.raw
  modified_base (243)..(243): a, c, t, g, unknown or other
  misc_feature (243)..(243): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (498)..(498): a, c, t, g, unknown or other
  misc_feature (498)..(498): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagctcccaaactcatcatttatgatgtcagtaatcggccctcaggggtttctaatcgcttctcctggctccaagtctgggcaacacggcctccctgaccatctctgggctccaggctgatgacgagctgattatactgcaggtcatanacaatcanacaactacttatgtcttcgggacttgggaccaagatcacgttcagtcagcccaagcccaacccncttcgtaacc

SEQ ID NO: 331619 - DNA, 518 bp, Homo sapiens
  misc_feature: GZ8MTXP01BXA26.21.81.H04.1.454.CMB.2.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcacatctctgcactggaaccngcggtnacgttggtctttatgactatgtctctggtaccaacaatacccaggcaaacgccccaaactcatcatttatgatgtcagtaatcgcctcaggggtttctaatcgcttctctcggctcaagtctggacaacncggcctcctgaccatctctgggctcaggctgatgacgaggctgattagtacngcaggtcatatacaatcagcaactcttaatgttcttcgggaactgggaccaagataccaccgttcccttgggttccaaggcccaaaggcccaacccacgtgttctaaccc

SEQ ID NO: 331620 - DNA, 518 bp, Homo sapiens
  misc_feature: GZ8MTXP01BUV3E.21.81.H04.1.454.CMB.2.raw
  modified_base (268)..(268): a, c, t, g, unknown or other
  misc_feature (268)..(268): n is a, c, g, or t
  modified_base (366)..(366): a, c, t, g, unknown or other
  misc_feature (366)..(366): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttttatgactatgtctcctggtaccaacaanaccccaggcaaaagcccccaaaactcatcatttatgatgtcagtaatcggccctcagggggtttctaatcgcttctctcggctcaagtctggacaacncgcctccctgaccatctctgggctccaggctgatgacgaggctgattattacngtcaggggtcatatacaatcagcaaacncttatgtcttcgggaactgggacctaagatcaccgttcaggttcaagccaagcccaacccatcgttcaacg

SEQ ID NO: 331621 - DNA, 550 bp, Homo sapiens
  misc_feature: GZ8MTXP01BSWEH.21.81.H04.1.454.CMB.2.raw
  modified_base (270)..(270): a, c, t, g, unknown or other
  misc_feature (270)..(270): n is a, c, g, or t
  modified_base (368)..(368): a, c, t, g, unknown or other
  misc_feature (368)..(368): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaaccaacaanacccaggacaaacgacccccaaactcatcatttatgatgtcagtaatcggcctcgtagggtttctaatcgcttctctcggctcaagtctaggacaacncgcctcctcgaccatctctcgggctcgaggctgatgacgagctgaattatactgcagggtcataactactaaatcaagcaaactacttatgttcgtcgggaactcgggaaccaaaggctaccgaaccgttcgttacgggttcaaccgacccgaacggaccccaacccttctcgttcctaacc

SEQ ID NO: 331622 - DNA, 568 bp, Homo sapiens
  misc_feature: GZ8MTXP01A843D.21.81.H04.1.454.CMB.2.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtnacgttggtctttangactatgtctcctggtaccaacaatacccaggcaaaagcccccaaaatcatcatttatgatgtcagtaatcggccctcagggggtttctaatcgcttctctggctcaagtctggacaacncggcctccctgacccatctctgggctcaggctgatgacgaggctagacttattacgngacgtagggtcaattaactaacaatcaagacctaaactactttagtcggttcgttcgggaactcgggaaacctaagttactaccgtaaccgttcgttacggttaccaacgaccccgaacgacccctaacccgttactccgttcctaacg

SEQ ID NO: 331623 - DNA, 555 bp, Homo sapiens
  misc_feature: GZ8MTXP01EY2PL.21.81.H04.1.454.CMB.2.raw
  modified_base (366)..(366): a, c, t, g, unknown or other
  misc_feature (366)..(366): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaaactcatcatttatgatgtcagtaatcggccctcgaggggttttctaatcgcttctctcggctcaagtctggacaacncggcctccctgaccatctctcgggctccaggctgatgacgaggctgattatactgcaggggtcatataacaatcagacaaactcttaatcgtcgtttcggggaacttacggggacccaaaggactccgaacccgttccgttaagggttccaacgcccaaacgggcccaaccccacgtcgttctaacccg

SEQ ID NO: 331624 - DNA, 528 bp, Homo sapiens
  misc_feature: GZ8MTXP01D2J11.21.81.H04.1.454.CMB.2.raw
  modified_base (365)..(365): a, c, t, g, unknown or other
  misc_feature (365)..(365): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaaactcatcatttatgatgtcagtaatcggccctcagggggtttctaatcgcttctctcggctcaagtctggacaacncggcctccctgaccatctctgggctccaggctgatgacgaggctgattatactgcaggggtcatatacaatcagcaaacacttatgtctcgggaactgggaccaagatccgaccgttcgttaggttcaagaccccaaggccccaaccccactcgttctaaccc

SEQ ID NO: 331625 - DNA, 519 bp, Homo sapiens
  misc_feature: GZ8MTXP01EIZIP.21.81.H04.1.454.CMB.2.raw
  modified_base (266)..(266): a, c, t, g, unknown or other
  misc_feature (266)..(266): n is a, c, g, or t
  modified_base (358)..(358): a, c, t, g, unknown or other
  misc_feature (358)..(358): n is a, c, g, or t
  modified_base (438)..(438): a, c, t, g, unknown or other
  misc_feature (438)..(438): n is a, c, g, or t
  modified_base (469)..(469): a, c, t, g, unknown or other
  misc_feature (469)..(469): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgcccctgactcagcctgcctccgtgtctggggtctcctggacagtcgatcaccatctcctgcactggaaccagcggtgacgttggtctttatgactatgtctctgtacaacaanacccaggcaaagccccaaatcatcatttatgatgtcagtaatcggccctcagggggttttctaatcgcttctctggctcaagtctggcaacncggcctccctgaccatctctgggctccaggctgatgacgaggctgattatactgcaggggtcatatacaatcagcaaacncttaatgttctgggaacttggggaccaaagntcaaccgttcttaggttcaacggcccaacggccacccactcgttctaacc

SEQ ID NO: 331626 - DNA, 569 bp, Homo sapiens
  misc_feature: GZ8MTXP01AI1YV.21.81.H04.1.454.CMB.2.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaagcccccaaactcatcatttangatgtcagtaatcggcctcaggggtttctaatcgtcttctctcggctcaagtctggacaacncgctccctgaccatctctcgggctccaggcttagataggacgaggtctgtaattactacgcgtacgaggtactattaanaacctaatcanacctaactacttgtacgttccgtacgggtaacgtacgggaaaccaggactaccgtacccgttacgttcgaccgaaccgaccgaaccggaaccccaacccgttctcgttaacgtccc

SEQ ID NO: 331627 - DNA, 532 bp, Homo sapiens
  misc_feature: GZ8MTXP01DYJ75.21.81.H04.1.454.CMB.2.raw
  modified_base (243)..(243): a, c, t, g, unknown or other
  misc_feature (243)..(243): n is a, c, g, or t
  modified_base (365)..(365): a, c, t, g, unknown or other
  misc_feature (365)..(365): n is a, c, g, or t
  modified_base (444)..(444): a, c, t, g, unknown or other
  misc_feature (444)..(444): n is a, c, g, or t
  modified_base (522)..(522): a, c, t, g, unknown or other
  misc_feature (522)..(522): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaaataccccaggcaaaagcccccaaactcatcatttatgatgtcagtaatcggccctcagggggtttctaatcgcttctctggctcaagtctggacaacncggcctccctgaccatctctgggctccgaggctgatgacgaggctgattatactgcaggggtctaatataacaatcgancaaactcttaatgtcttcgggaactgggactaaacgatctaccgttcttaggttccaagacccaacggcccaaacccnctcgctaacc

SEQ ID NO: 331628 - DNA, 561 bp, Homo sapiens
  misc_feature: GZ8MTXP01BQYMJ.21.81.H04.1.454.CMB.2.raw
  modified_base (243)..(243): a, c, t, g, unknown or other
  misc_feature (243)..(243): n is a, c, g, or t
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
  modified_base (443)..(443): a, c, t, g, unknown or other
  misc_feature (443)..(443): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttangactatgtctcctggtaccaacaataccccaggcaaagcccccaaaactcatcatttatgatgtcagtaatcggccctnaggggtttctaatcgcttctctcggctcaagtctggacaacncggcctccctgaccatctctgggctccaggctgatgacgaggctgattagttacngcaggggtcatatacaaatcgaanacaaactacttatcgtcgtacgggtaacgtacgggaaccaaagttacgtaccgtaaccgttaccgttacggttaccaacgaacccgaaacggaccccaaccccactcgttcctaaccg

SEQ ID NO: 331629 - DNA, 537 bp, Homo sapiens
  misc_feature: GZ8MTXP01D90V2.21.81.H04.1.454.CMB.2.raw
  modified_base (367)..(367): a, c, t, g, unknown or other
  misc_feature (367)..(367): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (527)..(527): a, c, t, g, unknown or other
  misc_feature (527)..(527): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggacaaacgccccaaactcatcatttatgatgtcagtaatcggtccctcgtaggggtttctaatcgcttctctcggctcaagtctggacaacncggcctccctgaccatctcgtcgggctccgaggctgatgacgaggtctagtattacttactgcagggtctaatataacatcanacaactnttatgtcgttcgggaactgggaccaagactcgtaccgttcgttggacaacgcccgaacgcccaaaccccnctccgttctc

SEQ ID NO: 331630 - DNA, 550 bp, Homo sapiens
  misc_feature: GZ8MTXP01BOFQ7.21.81.H04.1.454.CMB.2.raw
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaacgcccccaaactcatcatttatgatgtcagtaatcggccctcaggggtttctaatcgcttctctcggctcaagtctggacaacncggcctccctgacccatctcgtcgggctccaggctgatgacgagctgattatactgcaggggtctatatacaatcagacaaactacttatcgtcgttcgggaactacgggaccaaagactaccgaccgttaccgttaggttaccaacgaccccgaacggccccaaccccgactcgttcctaacccg

SEQ ID NO: 331631 - DNA, 549 bp, Homo sapiens
  misc_feature: GZ8MTXP01BD7WO.21.81.H04.1.454.CMB.2.raw
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (477)..(477): a, c, t, g, unknown or other
  misc_feature (477)..(477): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgtcctgactcagcctgcctccgtgtctgggtctcccgggcagtcggtcaccatctcttgcgctggatccagcgatgatattggacgttttaaccttgtctcctggtatcaacacacaggacaaagccccaaaatcttaaattcngctcaatcagcgaccctcacatgtttccagtcgattcnctgccatccaagtctggccaacncggcctttcngacaatctctcaactccaggctgaagacgaggctatttactactgctcctcagtacgctaggtcggctacttatttttcgttgggtttttggccgggtccgggtaacccnggtaacttgacttcggttcctcgagttcacgcccaagggtcctcgcccccgtggttcctccgttccttcccg

SEQ ID NO: 331632 - DNA, 519 bp, Homo sapiens
  misc_feature: GZ8MTXP01CCFGQ.21.81.H04.1.454.CMB.2.raw
  modified_base (363)..(363): a, c, t, g, unknown or other
  misc_feature (363)..(363): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaactcatcatttatgatgtcagtaatcggccctcagggggtttctaatcgcttctctcggctcaagtctggacaacncggcctccctgaccatctctgggctcaggctgatgacgaggctgattattactgcaggggtcatatacaatcaagcaacattatgtcttgggaactgggaccaagactcgaccgttcgttaggttcaacgcccaaggcccaacccgctcgctaacc

SEQ ID NO: 331633 - DNA, 547 bp, Homo sapiens
  misc_feature: GZ8MTXP01CKFE7.21.81.H04.1.454.CMB.2.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaaactcatcatttangatgtcagtaatcggccctnaggggtttctaatcgcttctctcggctcaagtctggcaacncgcctccctgaccatctctgggctccaggctgatgacgaggctgattattacngcaggggtcaattanacaatcagacaaacacttatgttacgttcggggaacttggggaaccaaaggcttaccacccggttccttaggttcaaacggccccaaaggccccaaaccccgactcgttcctaaccg

SEQ ID NO: 331634 - DNA, 540 bp, Homo sapiens
  misc_feature: GZ8MTXP01APVLX.21.81.H04.1.454.CMB.2.raw
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaagcccccaaactcatcatttatgatgtcagtaatcggccctcagggggtttctaatcgcttctctcggctcaagtctggacaacncggcctccctgaccatctctgggctcaggctgatgacgnggctgattatacgtgcgaggggtcaatataacaatcagacaaactcttaatgtcgttcgggaacttggggaaccaagactccgaccgttccgttaggttccaagccccaacgggaccccaacccactcgttctaacc

SEQ ID NO: 331635 - DNA, 524 bp, Homo sapiens
  misc_feature: GZ8MTXP01BK8K2.21.81.H04.1.454.CMB.2.raw
  modified_base (243)..(243): a, c, t, g, unknown or other
  misc_feature (243)..(243): n is a, c, g, or t
  modified_base (363)..(363): a, c, t, g, unknown or other
  misc_feature (363)..(363): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
  modified_base (513)..(513): a, c, t, g, unknown or other
  misc_feature (513)..(513): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctcgaggggtttctaatcgcttctctcggctcaagtctggacaacncggcctccctgaccatctcgtcgggctccaggctgatgacgngctgattatactgcaggggtcatatacaatcanacaaactcttatgtcttcgggaactgggaccaaagntccgacgttccgttggttccaagcccaaggcccaacccntcgttctaacc

SEQ ID NO: 331636 - DNA, 569 bp, Homo sapiens
  misc_feature: GZ8MTXP01EBOB4.21.81.H04.1.454.CMB.2.raw
  modified_base (244)..(244): a, c, t, g, unknown or other
  misc_feature (244)..(244): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaanacccaggcaaagccccaaatcatcatttatgactnagtaatacgccctctagggtttctaatcgtcttctctggcctaccaagtcgtcgcaaacacggccctccctacgaccactctctcggactccagctcgatgacgaggctagtattaattactgacgtaggtactattaattaaaccaataacaagactaaactaacctttaagttgtcgttacgggtactaacgggacaaacgattccgaccgtcccttaggttccacgcccaacggaacccaacccacttcgtccttaactcccg

SEQ ID NO: 331637 - DNA, 541 bp, Homo sapiens
  misc_feature: GZ8MTXP01B9RUF.21.81.H04.1.454.CMB.2.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (360)..(360): a, c, t, g, unknown or other
  misc_feature (360)..(360): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgccccaaatcatcatttangatntcagtaatcggcctcaggggtttctaatcgcttctctcggctcaagtctggacaacncggcctccctgaccatctctgggctccaggctgatgacgaggtctagattatactgctaggggtcaatanaacaatcanacaaactacttatgttcgtcgggaactagggaccaaggacttcgaccgttccgttaggttacaacgcccgaaaggaccccaacccttactcgttctaacccg

SEQ ID NO: 331638 - DNA, 554 bp, Homo sapiens
  misc_feature: GZ8MTXP01CELWB.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
  modified_base (494)..(494): a, c, t, g, unknown or other
  misc_feature (494)..(494): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttggtctttangactatgtctcctggtaccaacaatacccaggcaaacgcccccaaactcatcatttatgatgtcagtaatcggcctctaggggtttctaatcgcttctctcgctacaagtctggacaacncgcctcctgaccatctcgtcggctcgaggctgatgacgngtctgtattatacngcagggtcaatataacaatcaagactaactacttaatcgttacgttcggggaacttgggaaaccctaaagacgttaccncggttaccttagggttccaacgacccgaaacggcccaaaccccgttctcgttctaacccg

SEQ ID NO: 331639 - DNA, 607 bp, Homo sapiens
  misc_feature: GZ8MTXP01D0ISF.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (369)..(369): a, c, t, g, unknown or other
  misc_feature (369)..(369): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaacacccaggacaaacgaccccaaactcatctaatttatgatgtacagtaactcggccctcgtagggtttctaatcgtcttctctcggctcaagtctggacaacncggccctcctgacctatctcgtcgggctccgaggtctgagtcggaacgaggtctagtaattacgttaactgacctaggggtctaattaactaacaaatcaagacctaaactacttagtcgtccgttacggggaacgtacggggaaccaaaggttactacccgtaacccgttaccgttaggttacccgaacgaccccgaaacggaccccaaaccccttacgtaaccgttccgtaacccg

SEQ ID NO: 331640 - DNA, 557 bp, Homo sapiens
  misc_feature: GZ8MTXP01EDOUM.21.81.H04.1.454.CMB.2.raw
  modified_base (244)..(244): a, c, t, g, unknown or other
  misc_feature (244)..(244): n is a, c, g, or t
  modified_base (368)..(368): a, c, t, g, unknown or other
  misc_feature (368)..(368): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttangactatgtctcctggtaccaacaataccccaggcaaaacgcccccaaaactcatcatttatgatgtcagtaatcggccctcgaggggtttctaatcgcttctctcggctcaagtctggacaacncggcctcctgaccatctctgggctccaggctgatgacgaggctagattattactgcaggggtcaatatacaatcagacaaactacttatgtacgttcggggaacttacggggaacccaaaggactccgtaaccggttccttagggttaccaacgacccaaacgggccccaaaccccatcgttctaaccc

SEQ ID NO: 331641 - DNA, 530 bp, Homo sapiens
  misc_feature: GZ8MTXP01EKHPE.21.81.H04.1.454.CMB.2.raw
  modified_base (244)..(244): a, c, t, g, unknown or other
  misc_feature (244)..(244): n is a, c, g, or t
  modified_base (366)..(366): a, c, t, g, unknown or other
  misc_feature (366)..(366): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggacaaacgccccaaactcatcatttatgatgtcagtaatcggcctctaggggtttctaatcgtcttctctcggctcaagtctggacaacncggcctccctgaccatctctgggctcaggctgatgacgaggctgattatactgctaggggtcatatacaatcagacaactacttatgtctcgggaactcgggaacaagactcgacccgttcgttaggttccaaggacccaaggcccaaccccatcgttctaacc

SEQ ID NO: 331642 - DNA, 648 bp, Homo sapiens
  misc_feature: GZ8MTXP01E05OT.21.81.H04.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcgtgacgttggtctttangactatgtctcctggtaccaacaactacccaggacaaacgccccaaacgtcagtctatttangatgtcagtaatccggcctacgtagggggtttctaagtcgtacttctcgtcggtacctacgtaacgttcgtaggtaccaacgtccgggtccctccgtacgacctatcgtcgtcgggacctcgaggtcgtagtacgtggtacgacggtcttagtacttacgtacgtagacgtacggggtactaagttaactacgaactcgaagtactaaacctacgttacgtcgtaccgttacggaacgtacgggaacctaaagttacgttaccgtaacccgttaccggttacggttcccaacggtaccccgtaacggtacccctaacccgacgttaaccgttcgttaaccccgg

SEQ ID NO: 331643 - DNA, 556 bp, Homo sapiens
  misc_feature: GZ8MTXP01BP3PV.21.81.H04.1.454.CMB.2.raw
  modified_base (363)..(363): a, c, t, g, unknown or other
  misc_feature (363)..(363): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaactcatcatttatgatgtcagtaatcggccctcaggggtttctaatcgcttctctcggctcaagtctggacaacncggcctccctgaccatctctgggcctccgaggctgatgacgaggctgattatactgcaggggtcatatacaatcaagacaaactacttaatcgttcgttcggggaacttggggaaccctaaaggactaccgtacccgttccgttaggttccaacgccccgaaacggccccaaaccccactcgttccgtaaccc

SEQ ID NO: 331644 - DNA, 566 bp, Homo sapiens
  misc_feature: GZ8MTXP01C3KOT.21.81.H04.1.454.CMB.2.raw
  modified_base (243)..(243): a, c, t, g, unknown or other
  misc_feature (243)..(243): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctcgaggggtttctatcgtcttctctgctcagtctggacaacncggcctccctgaccatctctcgggctcaggctgatgacgaggctagattatactgacaggggtacattatacaatacaagactaaactaacttattacgtcgtttcgggtaacgtacgggttacgaaacgaacgttaccgtaccgttaccgttacggttacgaacgacccgaaccgacccgaaccccacctaacgttccgtaaccc

SEQ ID NO: 331645 - DNA, 550 bp, Homo sapiens
  misc_feature: GZ8MTXP01CJWWM.21.81.H04.1.454.CMB.2.raw
  modified_base (243)..(243): a, c, t, g, unknown or other
  misc_feature (243)..(243): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (536)..(536): a, c, t, g, unknown or other
  misc_feature (536)..(536): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggacaaacgcccccaaactcatctatttatgatgtcagtaactcggccctcgtaagggtttctaagtcgcttctctcggctcaagtctggacaacncgcctccctgacatctcgngggacctcgaggctgatgacgaggtctagatttatactgctagggtctaatactacaatcagacaactattatgtcgttagggaactggggaccaaaggctaccgaccgttcgttggttaccaacgacccgaacggccccaaaccccntccgttcctaaccg

SEQ ID NO: 331646 - DNA, 545 bp, Homo sapiens
  misc_feature: GZ8MTXP01ELGSL.21.81.H04.1.454.CMB.2.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttangactatgtctcctggtacaaacaatacccaggcaaacgcccccaaactcatcatttangatgtcagtaatcggccctcgtagggggtttctaatcgcttctctcggctcaagtctggacaacncggcctccctgaccatctctgggctccaggctgatgacgaggctgattatactgactaggggtcaattatacaatcaanactaaactcttatcgttcgtcggaacgtacggaacaagactaccgtaccgttcgttacgttaccaacgacccgaacgacccaacccttactcgttctcc

SEQ ID NO: 331647 - DNA, 522 bp, Homo sapiens
  misc_feature: GZ8MTXP01B19JB.21.81.H04.1.454.CMB.2.raw
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaactcatcatttatgatgtcagtaatcggccctcagggggtttctaatcgcttctctcggctcaagtctggacaacncggcctccctgaccatctctgggctccaggctgatgacgaggctgattattacngcaggggtcatatacaatcagcaaactcttatcgtcttcgggaactgggaccaaagctcaccgttcttggttcaagcccaaggcccaacccactcgttctaacc

SEQ ID NO: 331648 - DNA, 551 bp, Homo sapiens
  misc_feature: GZ8MTXP01BA237.21.81.H04.1.454.CMB.2.raw
  modified_base (244)..(244): a, c, t, g, unknown or other
  misc_feature (244)..(244): n is a, c, g, or t
  modified_base (366)..(366): a, c, t, g, unknown or other
  misc_feature (366)..(366): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaactacccaggacaaacgacccccaaactcatcatttatgatgtcagtaatcggcctcgtagggtttctatcgtcttctctcggctcagtctggacaacncggcctcccgtgaccatctcgtcgggctccgaggctgatgacgagctagtattatactgcgagggtacataatacaatcagacaaactacttagtcgttcctcggggtaactggggaaccaagctacgacccgttcgttacgggttcaacggccccaacggacccaacccgctcgttctaacccg

SEQ ID NO: 331649 - DNA, 534 bp, Homo sapiens
  misc_feature: GZ8MTXP01D0YOE.21.81.H04.1.454.CMB.2.raw
  modified_base (243)..(243): a, c, t, g, unknown or other
  misc_feature (243)..(243): n is a, c, g, or t
  modified_base (362)..(362): a, c, t, g, unknown or other
  misc_feature (362)..(362): n is a, c, g, or t
  modified_base (522)..(522): a, c, t, g, unknown or other
  misc_feature (522)..(522): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaagccccaaactcatcatttatgatgtcagtaatcggccctctaggggtttctaatcgcttctctcggctacaagtctggacaacncggcctcctgaccatctctgggctccaggctgatgacgagctgattattactgcaggggtcataatacaaatccaagacaaacacttatcgtcgttcggggaacttggggaccaaagacttcaaccgttccgttaggcaaggcccaaaggcccaaacccnctcgttctaacc

SEQ ID NO: 331650 - DNA, 552 bp, Homo sapiens
  misc_feature: GZ8MTXP01CHVRK.21.81.H04.1.454.CMB.2.raw
  modified_base (367)..(367): a, c, t, g, unknown or other
  misc_feature (367)..(367): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaacgcccccaaactcatcatttatgatgtcagtaatcggccctcgtaggggtttctaattcgcttctctcggctcaagtctggacaacncggcctccctgaccatctctgggctcgaggctgatgacgaggctgattatactgcagggtcatatacaatcagacaaactacttatcgttcgttcgggaacttcggggaaccaaggacttaccgaccgttcccgttaggttccaacgcccgaaacggtccccaaccccgacttcgttctaacccg

SEQ ID NO: 331651 - DNA, 568 bp, Homo sapiens
  misc_feature: GZ8MTXP01CTOWI.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (442)..(442): a, c, t, g, unknown or other
  misc_feature (442)..(442): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttggtctttangactatgtctcctggtaccaacaataccccaggacaaagcccccaaaactcatcatttatgatgtcagtaatcggccctactagggggtttctaaatcgcttctctcggctcaagtctggacaacncggcctcctgaccatcnctgggctcaggctgatgacgagctgattatactgcaggggtctaatatacaatcaancaaactcttaagtcgtcgttcggggaacttcggggaccaaaggttactacctaacccgttcgttacggttaccgaacgaccccgaaacggccccaaaaccccgttacttccgttaaccttaacccg

SEQ ID NO: 331652 - DNA, 589 bp, Homo sapiens
  misc_feature: GZ8MTXP01BXTQ8.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (374)..(374): a, c, t, g, unknown or other
  misc_feature (374)..(374): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaaccaacaanacccaggacaaacgcccccaaactcatctatttatgatgtcaagtaatccggccctcgtagggggtttctaatcgtcttctctcggctacaagtctggaacaacncggccctccctagacctatctcgtcgggctccgaggctgatgacgaggtctgattatactgcaggggtctaatatacaatcaagacaaactacttaagtcgttacgttcgggaacttacggggaaaccctaaaggactaccgtaaccggttaccgttacgggttaccaacgaccccgaaacggaccccaaacccgacttaacgttccttaacccg

SEQ ID NO: 331653 - DNA, 629 bp, Homo sapiens
  misc_feature: GZ8MTXP01EASIZ.21.81.H04.1.454.CMB.2.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccngcgtgtacgttgtnttangatntgtctctagtaacaacaacaccagacaaacaccccaatcatactattatgtatgtataagtacgtccgtccgtagtacggtttactattcgtcttctcgtcgctacgtagtcgtacgaaccaaccgccgtccctccgtacgacctacgtcgtcgtcggcctacgagtctagagtacggacggtagtactagtaattacttacgtagtacgtaacgggtactaaattaactaaactaagtaccgaacgtaacctaaacttacttagttacggttacgttacgggtaacgtacggaaactaagttaccgtaccgtacccgttacgttacggaccgaaccgacccgaacccgaacccctaacccgttacgttaaccgttaacctccg

SEQ ID NO: 331654 - DNA, 529 bp, Homo sapiens
  misc_feature: GZ8MTXP01DSK2K.21.81.H04.1.454.CMB.2.raw
  modified_base (242)..(242): a, c, t, g, unknown or other
  misc_feature (242)..(242): n is a, c, g, or t
  modified_base (364)..(364): a, c, t, g, unknown or other
  misc_feature (364)..(364): n is a, c, g, or t
  modified_base (443)..(443): a, c, t, g, unknown or other
  misc_feature (443)..(443): n is a, c, g, or t
  modified_base (516)..(516): a, c, t, g, unknown or other
  misc_feature (516)..(516): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaaacgcccccaaactcatcatttatgatgtcagtaatcggccctcgtaggggtttctaatcgcttctctggctcaagtctggacaacncggcctccctgaccatctcgtgggctcaggctgatgacgaggctgattatactgcagggtcatatacaatcagcaaacncttatgtcttcgggaactggggaccaaaggactcgaccgttccgttaggttcaagaccccaaggcccaacccntaacgttctaacc

SEQ ID NO: 331655 - DNA, 549 bp, Homo sapiens
  misc_feature: GZ8MTXP01EU6JA.21.81.H04.1.454.CMB.2.raw
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctgtacaacaanacccagcaaagccccaaactcatcatttangatgtcagtaatcggccctcgtaggggtttctaatcgcttctctcgctcaagtctggacaacncggcctcctgaccatctctgggctccgagctgatgacgagctgattntatgcagggtcataanacaatccganacaaactnttatgttcgttcgggaaccgttggggaaccaaaggactccgtaaccgttccgttagggttacccaacggaccccaaacgggccccaaacccttacgtcgttcctaaccc

SEQ ID NO: 331656 - DNA, 607 bp, Homo sapiens
  misc_feature: GZ8MTXP01CG34H.21.81.H04.1.454.CMB.2.raw
  modified_base (367)..(367): a, c, t, g, unknown or other
  misc_feature (367)..(367): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggacaaacgcccccaaactcatctatttatgatgtcagtaactcggcctcgtagggtttctaatcgtcttctctcgctcaagtctggacaacncggccctcctgaccatctcgtcgggctccgaggctgatgacgaggtctagtattattactgactaggggtctaattactaacaatcaacgactaaactactttagtcgtttaccgttccggggaacgttcggggaaccctaaaggttactacccgtaacccggttaccgttacgggttaccaaccggacccccgaaagggacccccaaaccccgttaccgttaaccgttccttaaccccg

SEQ ID NO: 331657 - DNA, 537 bp, Homo sapiens
  misc_feature: GZ8MTXP01APS95.21.81.H04.1.454.CMB.2.raw
  modified_base (241)..(241): a, c, t, g, unknown or other
  misc_feature (241)..(241): n is a, c, g, or t
  modified_base (266)..(266): a, c, t, g, unknown or other
  misc_feature (266)..(266): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaanacccaggcaaagcccccaaactcatcatttatgatgtcagtaatcggcctcaggggtttctaatcgcttctctcgccccaagtctggcaaacacggcctccctgaccatctctgggctccaggctgatgacgaggctgattattactgcagtcatatacaatcancaacacttatgtcttcgggntcggggaccaaaggacttccgaaacccgttccgttacggttccacgaaccccaacgggcccaaccccacttcgtccaacgttcccg

SEQ ID NO: 331658 - DNA, 593 bp, Homo sapiens
  misc_feature: GZ8MTXP01BZB8A.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaanacccaggacaaacgccccaaactcatcatttatgatgtcagtaatcggccctcgtaggggtttctaatcgtcttctctcggctcaagtctggacaacgccggccctccctgacctatctcgtcgggctccgaggctgatgacgaggctgattagtactgcagggtcaatatacaaatcaagacaaactacttatcgttcgttcgggaacgttacggggaaccaaaggttactaccgtaacccggttcccgttacgggttacccaacggacccccgaaacgggacccccaaacccccttacgttaaccgttaacctttaaccccg

SEQ ID NO: 331659 - DNA, 610 bp, Homo sapiens
  misc_feature: GZ8MTXP01A0C6A.21.81.H04.1.454.CMB.2.raw
  modified_base (268)..(268): a, c, t, g, unknown or other
  misc_feature (268)..(268): n is a, c, g, or t
  modified_base (463)..(463): a, c, t, g, unknown or other
  misc_feature (463)..(463): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttatgactatgtctcctggtaccaacaanaccaggacaaacgccccaaatcatctatttatgatgtcagtactcggcctgtagggtttctaatcgcttctctcggctcaagtctaggaaccaacgccggtccctccctcgacccatcctcgtcgggcctccgaggtctagatggacgtaggtctagacttatacgtgactaggggtacatactaacaatcgaanactaaactacttaagtcgttcgtcggggtaacttacggggaacctaacgacgttaccgtaacccggttccgttaacggttacccgaaaccggtaccccgaaaccgggtacccccaaccccgttaacgttccgttccctttaaccccg

SEQ ID NO: 331660 - DNA, 572 bp, Homo sapiens
  misc_feature: GZ8MTXP01CRHZP.21.81.H04.1.454.CMB.2.raw
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
  modified_base (366)..(366): a, c, t, g, unknown or other
  misc_feature (366)..(366): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttangactatgtctcctggtaccaacaanacccaggacaaacgccccaaactcatcatttatgatgtacagtaatcggccctcgtaggggtttctaatcgcttctctcggctacaagtctggacaacncggccctcctgaccatctctcgggctccaggctgatgacgaggctagattatactgcagggtcaatactacaatcaagacaaactacttatcgtcgtttcggggaacttacggggaacctaaaggacttaccgtaacccggttaccgttaggttacccaacgaccccaaacggaccccaaaccccgttacttcgttaacctaaccc

SEQ ID NO: 331661 - DNA, 543 bp, Homo sapiens
  misc_feature: GZ8MTXP01AGCQK.21.81.H04.1.454.CMB.2.raw
  modified_base (244)..(244): a, c, t, g, unknown or other
  misc_feature (244)..(244): n is a, c, g, or t
  modified_base (362)..(362): a, c, t, g, unknown or other
  misc_feature (362)..(362): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgccccaaactcatcatttatgatgtcagtaatcggccctgaggggtttctaatcgcttctctcgctcaagtctggacaacncggccctccctgacccatctctcgggctcgaggctgatgacgaggctgtattatactgcaggggtcatanacaatcanacaaactcttatgtcgtcgggaactacgggacctaagcgtaccgaaccgttcgttaggttccaacgaccccgaacggccccaacccacgtccgttcgtaaccc

SEQ ID NO: 331662 - DNA, 574 bp, Homo sapiens
  misc_feature: GZ8MTXP01DYZ9J.21.81.H04.1.454.CMB.2.raw
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttatgactatgtctcctggtaccaacaatacccaggcaaacgcccccaaactcatcatttatgatgtcagtaatcgccctgtaggggtttctaattcgcttctctcggctcaagtctggacaacncggcctcccngaccatctcgtgggcctccaggctgatgacgaggtctgattattctgcgtagggtcaatataacaatcaagacaaactactttattacgttcgtttccgggggaacttgggggaaacccaaaggttactaccgtacccgttaccttagggttaccaacggaccccgaacggaccccaacccgttactcgttcctaaccc

SEQ ID NO: 331663 - DNA, 535 bp, Homo sapiens
  misc_feature: GZ8MTXP01AKUDX.21.81.H04.1.454.CMB.2.raw
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgtctccgtgtctgggtctcctggacagtcgatcacatctcctgcactggaaccagcggtgacgttggtctttatgactatgtctcctggtacaacaatacccaggcaaacgccccaaactcatcatttatgatgtcagtaatcggccctcgtagggggtttctaatcgtcttctctcggctcaagtctggacaacncggcctccctgaccatctctcgggctccgaggctgagtgacgaggctgattatactgcaggggtcatatacaatcagacaactacttatgttcgttcgggaactgggaccaagacgtaccaccgttccgttagttcaacgcccgaacggcccaacccgctcgttctaaccg

SEQ ID NO: 331664 - DNA, 557 bp, Homo sapiens
  misc_feature: GZ8MTXP01BL65H.21.81.H04.1.454.CMB.2.raw
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttatgactatgtctcctggtaccaacaatacccaggacaaacgacccccaaactcatacatttatgatgtcagtaatcggcctcgtagggtttctaatcgcttctctggctcaagtctggacaacgcgcctccctgaccatctcgtcgggctccaggtctgagtcgacgaggctagattatactgcaggggtcattataacaatcagacaactacttagtcgttcgtggggaactagggaccaaagttactccgtaccgttcgttacgggttaccaacggacccgaacggccccaacccgttactcgttctaacccg

SEQ ID NO: 331665 - DNA, 587 bp, Homo sapiens
  misc_feature: GZ8MTXP01ETMUL.21.81.H04.1.454.CMB.2.raw
  modified_base (362)..(362): a, c, t, g, unknown or other
  misc_feature (362)..(362): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagccccaaactcatcatttatgatgtcagtaatcggccctcgtagggtttctaatcgcttctctcggctcaagtctgacaacncggcctccctgaccatctctcgggcctccgaggctgatggacgaggtctagtattattactgcaggggtacaattaataacaatcaagacctaaactacttatcgttcgttcggggaactacggggaacccaaaggttactaccgtaaccggttccgttacgggttaccaaccggaccccaaacgggccccctaaaccccgttacttaaccggttccctaacccg

SEQ ID NO: 331666 - DNA, 565 bp, Homo sapiens
  misc_feature: GZ8MTXP01AX53C.21.81.H04.1.454.CMB.2.raw
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttangactatgtctctgtaccaacaanaccagcaaacgccccaaactcatcatttatgatgtacagtaatcggcctcgtagggtttctatcgtcttctctcggctcaagtctgacaacncgcctccctgaccatctcgtcggctccgaggctgatgacgagctgattatacngcagggtcaattactaacaatccaagacctaaacctattagtcgtaccgttcgggaacttcggggaaacccaaggttactaccgtaaccgttcccgttaggttacccaacggaccccaacggaccccaaccccgttactcgttaaccctaacccg

SEQ ID NO: 331667 - DNA, 529 bp, Homo sapiens
  misc_feature: GZ8MTXP01DYDGO.21.81.H04.1.454.CMB.2.raw
  modified_base (245)..(245): a, c, t, g, unknown or other
  misc_feature (245)..(245): n is a, c, g, or t
  modified_base (366)..(366): a, c, t, g, unknown or other
  misc_feature (366)..(366): n is a, c, g, or t
  modified_base (519)..(519): a, c, t, g, unknown or other
  misc_feature (519)..(519): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtcttttangactatgtctcctggtaccaacaataccccaggcaaagcccccaaactcatcatttatgatgtcagtaatcggccctctagggggtttctaatcgcttctctggctcaagtctggacaacncggcctccctgaccatctctgggctccaggctgatgacgaggctgattatactgcaggggtcaatatacaatcagcaaacacttatagtcgttcgggaacttgggacctaagactcaccgttcgttaggttcaaggcccaacggcccaacccnctcgctaacc

SEQ ID NO: 331668 - DNA, 518 bp, Homo sapiens
  misc_feature: GZ8MTXP01A8Q14.21.81.H04.1.454.CMB.2.raw
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttangatgtcagtaatcggccctcagggggtttctaatcgcttctctcggctcaagtctggacaacncggcctccctgacccatctctgggctccaggctgatgacgaggctgattattacngcaggggtcatanacaatcaagcaaacncttatgtcttgggaactgggaccaagngtcaccgttcttggttcaagcccaaggcccaacccatcgttctaac

SEQ ID NO: 331669 - DNA, 540 bp, Homo sapiens
  misc_feature: GZ8MTXP01B3BJQ.21.81.H04.1.454.CMB.2.raw
  modified_base (366)..(366): a, c, t, g, unknown or other
  misc_feature (366)..(366): n is a, c, g, or t
  modified_base (423)..(423): a, c, t, g, unknown or other
  misc_feature (423)..(423): n is a, c, g, or t
  modified_base (484)..(484): a, c, t, g, unknown or other
  misc_feature (484)..(484): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaactcatcatttatgatgtcagtaatcggccctcgtaggggtttctaatcgtcttctctcggctcaagtctggacaacncggcctccctgaccatctcgtgggctccgaggctgatgacgaggctgtattattacngcagggtcatatacaatcagacaaacacttaatgtcgtttgggaacttggggaacctaagntccgaaccgttccgttagggttcaacgacccaacggcccaacccacgtcgctaacc

SEQ ID NO: 331670 - DNA, 554 bp, Homo sapiens
  misc_feature: GZ8MTXP01CO004.21.81.H04.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctctgcactggaaccngcggtgacgttggtcttangactatgtctctgacaacaanacccagacaaanccccaaatcatcatttangatgtacagtaatcggcctcgtagggtttctaaatcgtcttctctcggctcaagtctggaacaacgccgcctcccngaaccntcctctgggcctccgaggctgatgacgaggctagtattatactgacagggtacaatatacaaatcaaanactaactacgttatcgtacgtacgggaactaacgggaaactaagttacgtaccgtaccgttcgttacggaccaaccgacccgaacgaccccaaccacgtcgttaacctaacg

SEQ ID NO: 331671 - DNA, 559 bp, Homo sapiens
  misc_feature: GZ8MTXP01AR3YB.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaactacccaggcaaacgcccccaaactcatctatttatgatgtacagtaatccggcctcgtaggggtttctaatcgtcttctctcggctcgaagtctggacaacgcggccctccctgaccatctcgtcgggctccgaggctgatgacgagctagattatactgcaggggtcatatacaatcagactaatacttatacgtcgttcgggaactaggggaacccaagttacgtcctaaccgttccgttaggttccaacgaccctaacggaccccaacccttactcgttcctaaccg

SEQ ID NO: 331672 - DNA, 555 bp, Homo sapiens
  misc_feature: GZ8MTXP01E2NB1.21.81.H04.1.454.CMB.2.raw
  modified_base (243)..(243): a, c, t, g, unknown or other
  misc_feature (243)..(243): n is a, c, g, or t
  modified_base (366)..(366): a, c, t, g, unknown or other
  misc_feature (366)..(366): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctcgtagggggtttctaatcgtcttctctcggctcaagtctggacaacncggcctccctgaccatctctgggctccgaggctgatgacgaggctgattattactgcaggggtcaatatacaaatcaagctaaacactttatgtacgtttcggggaacttggggaaccaaaggactaccgacccgttccgttagggttccaagccccgaaaggccccaaccccttactcgttctaaccc

SEQ ID NO: 331673 - DNA, 591 bp, Homo sapiens
  misc_feature: GZ8MTXP01EM1SS.21.81.H04.1.454.CMB.2.raw
  modified_base (305)..(305): a, c, t, g, unknown or other
  misc_feature (305)..(305): n is a, c, g, or t
  modified_base (373)..(373): a, c, t, g, unknown or other
  misc_feature (373)..(373): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaaacaatacccaggacaaacgacccccaaactcatcatttangatgtcagtaatcggtcctacgtaggggtttctaatcgtcttctctcggcctcaagtctggaacaacncgcctccctgaccatctctcgggctccgaggctgatgacgaggtctgtattatactgcaggggtcaattatacaatccaagactaaactacttatcgttcgtttcggggaacttcggggaaacccaaaggttactaccgtaacccggttcccgttaaggggttccaacggacccccgaaagggccccaaaccccgttcttaaccgttccttaaccccg

SEQ ID NO: 331674 - DNA, 575 bp, Homo sapiens
  misc_feature: GZ8MTXP01A267E.21.81.H04.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
  modified_base (366)..(366): a, c, t, g, unknown or other
  misc_feature (366)..(366): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtcttangactatgtctctggtaccaacaanaccaggcaaacgccccaaatcaatcatttatgatgtacagtaatccggcctcgtaggggtttctaatcgtcttctctcggtctacaagtctggaacaacncggcctccctgaccatctcgtcggctcgaggctgatgacgagtcttagattatactgtacgacggggtactaatactaactaaatcaagtacaactacttatcgttacgtcgggaactcgggacctaaaggttctacctaccggttcgttaacgggttccaaacggccccaacgggaccccaaccccgttacgtccgttccttaacccg

SEQ ID NO: 331675 - DNA, 553 bp, Homo sapiens
  misc_feature: GZ8MTXP01DLN7T.21.81.H04.1.454.CMB.2.raw
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
  modified_base (409)..(409): a, c, t, g, unknown or other
  misc_feature (409)..(409): n is a, c, g, or t
  modified_base (443)..(443): a, c, t, g, unknown or other
  misc_feature (443)..(443): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaaacaatacccaggcaaacgacccccaaactcatcatttatgatgtcagtaatcggcctcgtaggggtttctaatcgtcttctctcggctcaagtctggcaacncgcctccctgaccatctctcgggctccgaggtctgatgacgngctgattatactgcaggggtcataatacaatcancaaactcttatgtcgttcgggaactcgggaccaaaggactaccgacccgttaccgttacggttaccaacggaccccaacgggaccccaaccccacttcgttcctaacccg

SEQ ID NO: 331676 - DNA, 718 bp, Homo sapiens
  misc_feature: GZ8MTXP01BKE4D.21.81.H04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (392)..(392): a, c, t, g, unknown or other
  misc_feature (392)..(392): n is a, c, g, or t
  modified_base (693)..(693): a, c, t, g, unknown or other
  misc_feature (693)..(693): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtctttangactatgtctcctggtaccaacaactaccaggacaaacgaccccaaatcatacatttangatgtacagtaactcggaccttcgtagggtttactaatcgtcttctctcggctacgtaacgtcgtcggaaccaacgccggtcccttcccngaacccctacttccgtcgtacggggccttaccgaagggtccttgaacgttcggaaccgggagggttccttaggtaactttaacgttaactcggtacccgttaagggggtaacctaaagttaacttaaacccgaattaccgaaacgtacctaaaacttaccgtttagttacggttccggtttaccggggaaacgttacggggaaacccctaaagttaccgtacccgtaaccccgggtttaccgaaacgggttcccgaaaccgggacccccgtaaaaccgggtcccccaaaaccccccggttntaacccgggttaacccttaaccccg

SEQ ID NO: 331677 - DNA, 573 bp, Homo sapiens
  misc_feature: GZ8MTXP01CC3JU.21.81.H04.1.454.CMB.2.raw
  modified_base (244)..(244): a, c, t, g, unknown or other
  misc_feature (244)..(244): n is a, c, g, or t
  modified_base (370)..(370): a, c, t, g, unknown or other
  misc_feature (370)..(370): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgtctccgtgtctgggtctcctggacagtcgatcaccatctcctgcactggaaccagcggtgacgttggtctttangactatgtctctggtacaacaataccagacaaacgccccaaactcatcatttatgatgtacaagtaactcggacctcgtaggggtttactaatcgtcttctctcggctacgaagtctaggacaacnccggccctcctacgaccatctcgtcgggctccaggctagatgacgaggctagtacttatactgactaggggtcaattaataactaatcaacgactaaacctactttagtcgttcgttcgggaacgttacgggaaacctaaggactacgacccgttccgttagggttaccaacggacccaacggccccaacccactcgctaacc

SEQ ID NO: 331678 - DNA, 514 bp, Homo sapiens
  misc_feature: GZ8MTXP01AM9SC.21.81.H04.1.454.CMB.2.raw
  modified_base (363)..(363): a, c, t, g, unknown or other
  misc_feature (363)..(363): n is a, c, g, or t
  modified_base (449)..(449): a, c, t, g, unknown or other
  misc_feature (449)..(449): n is a, c, g, or t
  modified_base (504)..(504): a, c, t, g, unknown or other
  misc_feature (504)..(504): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaactcatcatttatgatgtcagtaatcggccctcagggggtttctaatcgcttctctcggctcaagtctggcaacncggcctccctgaccatctctgggctccaggctgatgacgaggctgattattactgcaggggtcatatacaatcagcaactacttangtcttcgggaactgggacaagatcaccgttcagttcaagcccaaggcccaacccnctcgctaacc

SEQ ID NO: 331679 - DNA, 576 bp, Homo sapiens
  misc_feature: GZ8MTXP01D36IE.21.81.H04.1.454.CMB.2.raw
  modified_base (246)..(246): a, c, t, g, unknown or other
  misc_feature (246)..(246): n is a, c, g, or t
  modified_base (381)..(381): a, c, t, g, unknown or other
  misc_feature (381)..(381): n is a, c, g, or t
  modified_base (469)..(469): a, c, t, g, unknown or other
  misc_feature (469)..(469): n is a, c, g, or t
  modified_base (508)..(508): a, c, t, g, unknown or other
  misc_feature (508)..(508): n is a, c, g, or t
tcagtcgtcgctcgcacgaccggtgctcgatttagtagtgtagattcgcggggggggtctcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttaangactatgtctctaggtaaccaaacaatacccaggacaaacgacccccaaaactcatctaatttatgatgtcaagtaatccgggccctcgtaggggtttctaatccgtcttctctcggctctaagtctgaacaacnccggcctcccgtacgacctatctctcgggctccgagctgatgacgaggctgtattattactgctaggggtacattaactaacaatcanactaaactacttatgttcgtcggaacgtaggaaccgaanacgtacgaccgttacgttacgggttacaacgacccgaacggtcccaaacccttctccgttctaacccc

SEQ ID NO: 331680 - DNA, 541 bp, Homo sapiens
  misc_feature: GZ8MTXP01ECAAI.21.81.H04.1.454.CMB.2.raw
  modified_base (244)..(244): a, c, t, g, unknown or other
  misc_feature (244)..(244): n is a, c, g, or t
  modified_base (375)..(375): a, c, t, g, unknown or other
  misc_feature (375)..(375): n is a, c, g, or t
  modified_base (463)..(463): a, c, t, g, unknown or other
  misc_feature (463)..(463): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttgngacttatgtctcctggtaccaacaaataccccaggacaaaacgcccccaaaactcatcatttatgatgtcagtaaatcggccctctaggggtttctaatcgcttctctcggctacaagtctggaccaaacnccggcctaccctgaaccatctctcgggctccgaggctgatgacgaggctgattatactgacaggggtcaatataacaatcagcaaacncttatgtcttcgggaatgggaccaagactcaccgttacttggttacaacgcccaaggcccaaccccgatcgttcaacc

SEQ ID NO: 331681 - DNA, 534 bp, Homo sapiens
  misc_feature: GZ8MTXP01C3049.21.81.H04.1.454.CMB.2.raw
  modified_base (243)..(243): a, c, t, g, unknown or other
  misc_feature (243)..(243): n is a, c, g, or t
  modified_base (369)..(369): a, c, t, g, unknown or other
  misc_feature (369)..(369): n is a, c, g, or t
  modified_base (488)..(488): a, c, t, g, unknown or other
  misc_feature (488)..(488): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttttangactatgtctcctggtaccaaacaaatacccaaggcaaaagcccccaaaactcatcatttaatgatgtcaagtaaatcggccctcaggggtttctaatcgcttctctggctcaagtctggacaacncggcctccctgaccatctctgggctccaggctggatgaacgaggctgattattactgcaggggttcataatacaaatcagcaaaactacttaatgtcttcgggaactggggaccaaagntcaaccgttccttggttcaagcccaaggccaaccccatcgctaacc

SEQ ID NO: 331682 - DNA, 558 bp, Homo sapiens
  misc_feature: GZ8MTXP01DIRPF.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (364)..(364): a, c, t, g, unknown or other
  misc_feature (364)..(364): n is a, c, g, or t
  modified_base (415)..(415): a, c, t, g, unknown or other
  misc_feature (415)..(415): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaanaatacccaggcaaaacgcccccaaactcatcatttatgatgtcagtaatcggccctcgtaggggtttctaatcgcttctctcggctcagtctggacaacncgcctccctgaccatctctgggctcgagctgatgacgaggctagattatcngcaggggtacattacacaatcagacaaactacttatcgttcgttcgggaacttcggggaaaccaaagttctacctaccggttaccgttagggttaccaacggaccccaaggaaccccaaccccgagttcgttaacctaacccg

SEQ ID NO: 331683 - DNA, 569 bp, Homo sapiens
  misc_feature: GZ8MTXP01A2JAX.21.81.H04.1.454.CMB.2.raw
  modified_base (551)..(551): a, c, t, g, unknown or other
  misc_feature (551)..(551): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacggggtcctgggcccagtctgccctgactcagcctgcctccgtgtctgggtctcctggacagtcgatcaccatctcctgcactggaaccagcggtgacgttgtctttatgactatgtctcctggtaccaacaatacccaggacaaacgcccccaaatcatcatttatgatgtcagtaatcggcccctcgtagggggtttctaatcgtcttctctcggcctaccaagtctcggacaaacaccggccctccctgacccatctcgtgggctccgaggctgatgacgaggctagatttatactgactaggtacatataacatcaacgcaactactttatcgttcttacgggaactaacggaaccaaaggacttccgaccgttcgttaggttccaacgccccgaaacggccccaaaccccgnttccgtccaaccttcccg

SEQ ID NO: 331684 - DNA, 528 bp, Homo sapiens
  misc_feature: GZ8MTXP01AUE66.21.81.H04.1.454.CMB.2.raw
  modified_base (242)..(242): a, c, t, g, unknown or other
  misc_feature (242)..(242): n is a, c, g, or t
  modified_base (363)..(363): a, c, t, g, unknown or other
  misc_feature (363)..(363): n is a, c, g, or t
  modified_base (428)..(428): a, c, t, g, unknown or other
  misc_feature (428)..(428): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgcccccaaactcatcatttatgatgtcagtaatcggccctctagggggtttctaatcgtcttctctcgctcaagtctggacacncggcctcctgaccatctctgggctcgaggctgatgacgaggctgattatactgcgagggtcatanacaatcagacaactattatcgtcttcgggaactcggggaccaagactcaccgttcgttaggttccaagcccgaacggcccaaccccactcgttctaaccg

SEQ ID NO: 331685 - DNA, 546 bp, Homo sapiens
  misc_feature: GZ8MTXP01DI9SA.21.81.H04.1.454.CMB.2.raw
  modified_base (244)..(244): a, c, t, g, unknown or other
  misc_feature (244)..(244): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgccccaaactcatcatttatgatgtcagtaatcggccctcgtaggggtttctaatcgtcttctctcggctcaagtctggacacncggcctccctgaccatctcgtgggctcaggctgactgaacgaggctgaacttnttacngacaggggtcatatacaatcagacaaactcttatcgtcttcggggaactggggaacccaagacgtaccgaccgttcgttgggttaccaacgcccgaacggccccaacccacttcgctaacccg

SEQ ID NO: 331686 - DNA, 549 bp, Homo sapiens
  misc_feature: GZ8MTXP01DGY9R.21.81.H04.1.454.CMB.2.raw
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (413)..(413): a, c, t, g, unknown or other
  misc_feature (413)..(413): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttangactatgtctctgtaccaacaanaccaggacaaagccccaaactcatcatttatgatgtcagtaatcggcctcgtagggtttctaatcgtcttctctcggctcaagtctggacaacncgcctccngaccatctcgtcgggctcgaggctgatgacgagtctgattatacngcaggtacataatacaatcagacaaacgtacttatgtcgttgggaacgtagggaacctaaagacgtaccgtaccgttaccgttggttaccaacgaaccccgaacggaccccaacccttactcgttaacctaacccg

SEQ ID NO: 331687 - DNA, 574 bp, Homo sapiens
  misc_feature: GZ8MTXP01CFA6B.21.81.H04.1.454.CMB.2.raw
  modified_base (370)..(370): a, c, t, g, unknown or other
  misc_feature (370)..(370): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaactacccaggacaaacgcccccaaactcatcatttatgatgtcagtaatcggccctcgtagggtttctaatcgcttctctcggctacaagtctaggaccaacnccggccctccctgacccatcctcgcgggcctccgagctgatgacgtagctagtattatactgactagggttctaattactaacaatcacgactaaactcttatcgtcgttcgggaacgtacgggaacctaaaggctaccgtaccgttccgttacggttaccaacgaaccccgaacggaccccaaccccgactcgttcctaaccc

SEQ ID NO: 331688 - DNA, 772 bp, Homo sapiens
  misc_feature: GZ8MTXP01AXUZ2.21.81.H04.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
tcagtcgtcgctcgcacgaccggtgctcgatttagtagtgtagattcgcgggggggtctcgaggaggcagcgctctcggggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaactaccaggacaaacgccccaaatcatcatttatgatgtcaagtaactccggtaccctcgtagggggtttactaagttccgtcgtttacctcgttccggaccttaccgtaagttacctacggaaaacccaaacccgtaacccggggtcccctaccccgtacggtaacccctaacttcccgttaccggttacggggtccccttacccgaacggggtcccgttagggtaacgttacgggaaaccgggtacggggttaccttagggttaactttaacgtttacgtacgtacgtacgggggttactaaagtttaactaaactaaactacgtaaagaaccttaaaacttacctttaagttccggtttaccggttaaccggggtaacggttacggggaaaccctaaaggaaccgttaccggtaacccggttaccggttaacgggttacccaaccggtaaccccgaaaccgggacccccaaaccccgttaccgtcggttaacccgtaacccg

SEQ ID NO: 331689 - DNA, 594 bp, Homo sapiens
  misc_feature: GZ8MTXP01B7FKO.21.81.H04.1.454.CMB.2.raw
  modified_base (222)..(222): a, c, t, g, unknown or other
  misc_feature (222)..(222): n is a, c, g, or t
  modified_base (361)..(361): a, c, t, g, unknown or other
  misc_feature (361)..(361): n is a, c, g, or t
  modified_base (438)..(438): a, c, t, g, unknown or other
  misc_feature (438)..(438): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttggtctttatgactatgtctcctggtaccaacaatacccaggacaaacgccccaaactcatcatttatgatgtcagtaatcggcctcaggggtttctaatcgcttctctcggctcaagtctggacaacncggcctaccctgaccatctcgtcgggctcaggctgatggacgaggctgattatactgcaggggtcatatacaatcanactaaacctattaatcgtacgtttcggggaacttacggggaaaccaaacggttacttacccgaaccggttacccgttaaggggttcccaaacgggtacccccgtaaaacggggacccccaaaacccccgttacttccgggttaaccgttaaccccg

SEQ ID NO: 331690 - DNA, 611 bp, Homo sapiens
  misc_feature: GZ8MTXP01DSZ28.21.81.H04.1.454.CMB.2.raw
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgtacgttggtctttangactatgtctcctggtaccaacaatacccaggacaaacgccccaaactcatctatttangatgtcaagtaactcggccctcgtaggggtttctaatcgtcttctctcggctctaagtttggacaaacaccggtccctccctgacccatcctcgtgggcctcgaggctgatgacgaggtctagtattacttacgtgacgtaggtactaataataacaaatcaagtacaactaacttagtgttaccgttacgggacgttaacggggaaccaaaggtacttaccgtaacccgttcgttacgggttccaacggaaccccgaaaccggtaaccccaaacccctacgttaccgtaacccgttaactttccccg

SEQ ID NO: 331691 - DNA, 548 bp, Homo sapiens
  misc_feature: GZ8MTXP01AO4YN.21.81.H04.1.454.CMB.2.raw
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
tcagtcgtcgctcgcacgaccggtgctcgatttagtagtgtagattcgcggggggggtctcaggaggcagcgctctcgggacgtctccaccatggcctgggctcttctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggacaaacgcccccaaactcatcatttangatgtcagtaatcggccctgaggggtttctaatcgcttctctggccctccaagtctggcaaacncggccctccctagacccatctcgtcgggctccaggctgatgacgaggctagtatttattactgacgtaggtcaattatacaaatcaagcaaactacttatcgttcttcgggactgggaaccaagacttccgaccgtcttagggttcacgcccacggcccaacccgcttacgtcaacgtccg

SEQ ID NO: 331692 - DNA, 582 bp, Homo sapiens
  misc_feature: GZ8MTXP01B3CUL.21.81.H04.1.454.CMB.2.raw
  modified_base (224)..(224): a, c, t, g, unknown or other
  misc_feature (224)..(224): n is a, c, g, or t
  modified_base (369)..(369): a, c, t, g, unknown or other
  misc_feature (369)..(369): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttatgactatgtctcctggtaccaacaatacccaggacaaacgcccccaaactcatcatttatgatgtcagtaatccggcctcgtagggtttctaatcgtcttctctcggctacaagtctggaacaacntcggccctccctgaccatctctgggctccgaggctgatggacgaggtctgtattaattactgactaggttcaattaataaccaatcgaagacaaactacttagtcgttcgtttaacgggaacttacggggaaccaaaggtactaccgacccggttacttacgggtaaccacggaaccccaaacggccccaaaaccccgtcgttaacgtaaccc

SEQ ID NO: 331693 - DNA, 562 bp, Homo sapiens
  misc_feature: GZ8MTXP01D5P81.21.81.H04.1.454.CMB.2.raw
  modified_base (362)..(362): a, c, t, g, unknown or other
  misc_feature (362)..(362): n is a, c, g, or t
  modified_base (454)..(454): a, c, t, g, unknown or other
  misc_feature (454)..(454): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaactcatcatttatgatgtcagtaatcggcctgtagggtttctaatcgcttctctggctcaagtctggacaacncggcctccctgaccatctcgtcgggctccgaggctgatgacgaggctagattattactgctagggtcaatatacaatcaagacaactacttntagttccgttcggggaactggggaaaccaagttactacccgtaccgttaccgttaggttccaacggaccccgaacggaccccaaccccacgttaacgttcctaacccg

SEQ ID NO: 331694 - DNA, 720 bp, Homo sapiens
  misc_feature: GZ8MTXP01BAGXY.21.81.H04.1.454.CMB.2.raw
  modified_base (224)..(224): a, c, t, g, unknown or other
  misc_feature (224)..(224): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtcttatgactatcgtctctaggtaaccaacaactaccaggaccaaacgacccccaaactcaactctaatttatagatgtactaagtaactccggtaccccttacgtacgggggttttactaacgttccgtactttctccgttccggtaccttacgtaacggttctacggaaaccctaaaccgtcccgggtaccctacccgtacgaccctacttccgtcgtcggggccttaccgaggtcgtagacgtacggaacggtacggtcgttacgtaacttattacgtgtacgacggggttactaagttaactaactaaagtcaacgtactaaaccgttacgtttacgttacggttaccggttacggggtaacgttaacggggaaacctaaacgttaccgtacccgtaacccgttacggttaacggacccgaacccggaccccggtaacggaccccctaacccgttaccgttccgttaacccttaacccg

SEQ ID NO: 331695 - DNA, 588 bp, Homo sapiens
  misc_feature: GZ8MTXP01E1USD.21.81.H04.1.454.CMB.2.raw
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaaacaatacccaggcaaacgcccccaaactcatcatttatgatgtcagtaatccggcctcgtaggggtttctaatcgcttctctcggctcaagtctggacaacncggcctccctagaccatctcgtgggctcaggctgatgacgaggctgtattatactgcaggggtcaatactaacaatcagtacaaactacttaagtgttccgttcggggaacttacggggaaccctaaaggttactaccgtaacccgttccgttaacggggttccaaccggaccccgaaacgggacccccaaaccccacgttaaccggttccgttaaccccg

SEQ ID NO: 331696 - DNA, 579 bp, Homo sapiens
  misc_feature: GZ8MTXP01ARXK0.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (379)..(379): a, c, t, g, unknown or other
  misc_feature (379)..(379): n is a, c, g, or t
  modified_base (415)..(415): a, c, t, g, unknown or other
  misc_feature (415)..(415): n is a, c, g, or t
  modified_base (466)..(466): a, c, t, g, unknown or other
  misc_feature (466)..(466): n is a, c, g, or t
  modified_base (560)..(560): a, c, t, g, unknown or other
  misc_feature (560)..(560): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaacgcccccaaactcatcatttatgatgtcaagtaatccggcctcgtaggggtttctaatcgcttctctcggctcaagtctggaacaacgcggcctcccgngaccatctcgtcgggcctccgaggctgaatgaacgngtctagtattacttactgcagggtcaattaataacaatccagactaaactnttaatcgtaccgttgggaactcgggaaacctaaagacgtaccgaccgttaccgttacgggttaccaaccgacccgaaccggacccctaaacccnccgttaacgccttaacccg

SEQ ID NO: 331697 - DNA, 533 bp, Homo sapiens
  misc_feature: GZ8MTXP01DQGN1.21.81.H04.1.454.CMB.2.raw
  modified_base (244)..(244): a, c, t, g, unknown or other
  misc_feature (244)..(244): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtacaacaatacccaggcaaagcccccaaactcatcatttatgatgtcagtaatcggcctcagggggtttctaatcgcttctctcggctcaagtctggacaacncggcctccctgacccatctctgggctccaggctgatgacgaggctgtattatactgacaggggtcatatacaatcagcaaactacttatgtcgttcgggaactgggaaccaagatcgtaccgttccttgggttccaaggacccaaacggcccaaaccccactcgcctaaccc

SEQ ID NO: 331698 - DNA, 577 bp, Homo sapiens
  misc_feature: GZ8MTXP01BWSOF.21.81.H04.1.454.CMB.2.raw
  modified_base (269)..(269): a, c, t, g, unknown or other
  misc_feature (269)..(269): n is a, c, g, or t
  modified_base (370)..(370): a, c, t, g, unknown or other
  misc_feature (370)..(370): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaanacccaggacaaacgcccccaaactcatctatttatgatgtcagtaactcggccctcgtaggggtttctaatcgtcttctctcggctcaagtctggacaacncggcctccctgaccatctctcgggctcgaggctgatgacgagctagattatactgacaggggtactatatacaatcagacaaacactttatcgttaccgttcgggaaccgttggggaaccaaaggttactacccgtaccgttaccgttacggttaccaacggaccccgaacgggaccccaaccccgttacttccgttccgtaacccg

SEQ ID NO: 331699 - DNA, 549 bp, Homo sapiens
  misc_feature: GZ8MTXP01BBVKI.21.81.H04.1.454.CMB.2.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttgtctttangactatgtctctggtaccaacaatacccaggacaaacgccccaaactcatcatttangatgtcagtaatcggccctgtagggtttcaatcgcttctctcggctcaagtctggaacaacncggcctccctgaccatctcgtgggctcgaggctgatgacgaggctagattatacgtgacaggggtctataatacaatcagacaaactattatgttcgtcgggaactcgggaacctaagactacgacccgttcgttacggttaccaacgaccccgaaacggccccaacccttactcgttccgtaaccc

SEQ ID NO: 331700 - DNA, 557 bp, Homo sapiens
  misc_feature: GZ8MTXP01DKEJA.21.81.H04.1.454.CMB.2.raw
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttatgactatgtctcctggtaccaacaatacccaggacaaacgacccccaaactcatcatttatgatgtacagtaatcggcctctaggggtttctaatcgtcttctctcggtctccaagtctggaccaacncggcctccctgaccatctctgggctcgaggctgatggacgaggctgtattatntgcaaggggtcaatatacaatcagcaaactcttatcgtcttcggggaacttggggaaccaaggttactaccacccggttcgttacggttaccaacggccccgaaacggacccaacccccattccgttctaacccg

SEQ ID NO: 331701 - DNA, 539 bp, Homo sapiens
  misc_feature: GZ8MTXP01A2LFY.21.81.H04.1.454.CMB.2.raw
  modified_base (244)..(244): a, c, t, g, unknown or other
  misc_feature (244)..(244): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (441)..(441): a, c, t, g, unknown or other
  misc_feature (441)..(441): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgcccccaaactcatcatttatgatgtcagtaatcggccctcgaggggtttctaatcgcttctctcggctcaagtctggacaacncggccctcctgaccatcnctgggctccgaggctgatgacgaggctgattatactgcaggggtcatatacaatcaancaactacttatcgtcttcgggaactcggggaccaaggactaccgaccgttcacggttccaacgacccgaacggccccaaccccgactcgttctaaccc

SEQ ID NO: 331702 - DNA, 559 bp, Homo sapiens
  misc_feature: GZ8MTXP01AWX1D.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
  modified_base (447)..(447): a, c, t, g, unknown or other
  misc_feature (447)..(447): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcggtgacgttggtctttangactatgtctcctggtaccaacaatacccaggacaaacgccccaaactcatcatttangatgtcagtaatcggcctcgtaggggtttctaatcgtcttctctcggctcaagtctggacaacncggcctccctagaccctatctacgtgggctccgaggctgatgacgagctagattactatgcaggggtcaatataacaatcaanacaaactacttatcgtcgttcggaacgttgggaacctaaagactaccgacccgttcgttacggacaacggaccccaacggaccccaaccccgttactaacgttcctaacccg

SEQ ID NO: 331703 - DNA, 586 bp, Homo sapiens
  misc_feature: GZ8MTXP01B7KXN.21.81.H04.1.454.CMB.2.raw
  modified_base (244)..(244): a, c, t, g, unknown or other
  misc_feature (244)..(244): n is a, c, g, or t
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaactacccaggaccaaacgacccccaaactcatctatttatgatgtcaagttaactcggtccctacgtaggggtttctaatcgtcttctctcggcctacaagtctggaaccaacnccggccctccctgacctatcctcgtgggcctcgaggctgatgacgngctgtattataactgcgtagggtactaagtaacttaacaatcacactaaactacttagtcgtacgttcgggaacgtacgggaaccaaggttactaccgtacgttccgttagttcccgaagtaccccgaagtaccccaacccttactccgttctaacccg

SEQ ID NO: 331704 - DNA, 562 bp, Homo sapiens
  misc_feature: GZ8MTXP01CRVBW.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (452)..(452): a, c, t, g, unknown or other
  misc_feature (452)..(452): n is a, c, g, or t
  modified_base (499)..(499): a, c, t, g, unknown or other
  misc_feature (499)..(499): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaactacccaggacaaacgaccccaaactcatcatttatgtatgtcaagtaatcggcctacgtaggggttactaatcgcttctctcggctactaagtctaggaccaacgccggccctccctcggaccctatcctcgtgggctccaggctgactagacgaggctgtattatactgcagggtcattaanacatcagacaactacttaatcgtcttcgggaactggggaacctaagntaccgtaccgttccgttacggcctaacgacccgaacggaccccaacccactcgttcctaaccc

SEQ ID NO: 331705 - DNA, 547 bp, Homo sapiens
  misc_feature: GZ8MTXP01APUNK.21.81.H04.1.454.CMB.2.raw
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctgtacaacaanaccaggacaaacgccccaaatcatcatttangatgtcaagtaactccggcctagacgggtttactaattcgtcttctcgtcgctcaagtctggacaacncgccctcctgacctntctcgtcgggctcgaggctgatgacgngctagattatnancgaggtctatanacatcagactaacattagtcgttcgtcgggaactgggaacctaaggactaccgaaccgttccgttacggcaacccgaccgaaaccggacccaacccttacgtcgttcctaacccg

SEQ ID NO: 331706 - DNA, 579 bp, Homo sapiens
  misc_feature: GZ8MTXP01DLZV1.21.81.H04.1.454.CMB.2.raw
  modified_base (372)..(372): a, c, t, g, unknown or other
  misc_feature (372)..(372): n is a, c, g, or t
  modified_base (417)..(417): a, c, t, g, unknown or other
  misc_feature (417)..(417): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttatgactatgtctcctggtaccaacaactacccagacaaacgaccccaaactcatctatttatgatgtcagtaatccggccctcgtaggggtttactaatcgtcttctctcggctacaagtctggaacaacncggccctccctgacctatctcgtcgggcctcgaggctgatgacgngtctagtattatactgacgtaggggtcaattaataacaatacagacctaaactacttagttcgtaccgttcggggtaactagggaaaccaaagctaccgaccgttccgttagggttaccaacgaccccgaacggaccccaaccccttacgtcgttctaaccc

SEQ ID NO: 331707 - DNA, 604 bp, Homo sapiens
  misc_feature: GZ8MTXP01CQJ6A.21.81.H04.1.454.CMB.2.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggcggtgacgttggtctttangactatgtctctgtaccaaacaanaccagacaaacgaccccaaatcatcatttangatgtacaagtaatccggcctcgtagggtttctaatcgcttctctcggctacaagtctaggaaccaacnccggccctcccgtagaccatctcgtcgggctcgaggtcgtgagtaggacgaggtctagaattattacgtagacgtaagggttctaataactactaaaatccgaaagactaaacttacttagttacggttaccgttacgggaacgtacgggaaactaaacgttacgtaaccgaccgttacgttacggaccaaccgacccgaacgaccccaaccgttacgtaacgttaaccgtaacc

SEQ ID NO: 331708 - DNA, 611 bp, Homo sapiens
  misc_feature: GZ8MTXP01AI24J.21.81.H04.1.454.CMB.2.raw
  modified_base (244)..(244): a, c, t, g, unknown or other
  misc_feature (244)..(244): n is a, c, g, or t
  modified_base (373)..(373): a, c, t, g, unknown or other
  misc_feature (373)..(373): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaactacccaggaccaaacgccccaaactcatcatttatgatgtcagtaactcggccctcgtacggggtttactaatcgtcttctctcggctcaagtctgaaccaacnccgccctccctgaccatctcgtcgggcctcgaggctgatgacgagctagattatactgcgtagggtacaattactaactaaatcgaacgacctaaacctactttacgttacgttcggttacggggaaccgtacgggaacctaaacggacttacccgtaacccggttccgttacgggttaccgaacccgaccccgaaccggacccccaaccccgaccgttccgttaacccgtaaccccg

SEQ ID NO: 331709 - DNA, 602 bp, Homo sapiens
  misc_feature: GZ8MTXP01BHMO6.21.81.H04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (389)..(389): a, c, t, g, unknown or other
  misc_feature (389)..(389): n is a, c, g, or t
  modified_base (478)..(478): a, c, t, g, unknown or other
  misc_feature (478)..(478): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtctttangactatgtctcctggtacaacaatacccaggacaacgccccaaatcatctatttangatgtacagtaactccggtacccttcgtaggggttttactaagtccgtcttctcgtcggcctctaagtctcggacaaccgcgccctcccngaccatctcgtcgggctcgaggtctagatgacggtaggcttagtatttatactgaccgtaggggtactaattaactaactaaatccganacctaaactacttagtcgtaccgttcgggaacgttcgggaaactaacggctaccgtaacccgttccgttaggttacccaacgaccccgaacggaccccctaacccttcgtcgttccctaacccg

SEQ ID NO: 331710 - DNA, 619 bp, Homo sapiens
  misc_feature: GZ8MTXP01CFUM7.21.81.H04.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgacgttggtctttangactatgtctctggtacaacaanaccaggacaaacgaccccaaactcatctatttatgatgtcaagtaatccggaccctcgtaggggtttctaatcgtcttctctcggctacaagtctggaccaacgcggccctccctgaccatctcgtcgggcctcgaggctgatggacgaggtctagtattattacgtgacgtaggggttactaattataactaataccaagacctaaactacttagttacgttcgttacggggaacgttaacggggaacctaaacggttacttacccgtaaccgttacccgttacgggaccaaccggtaccccgaaaccggaccccctaaaccccgttactaaccggttccgttaaccccg

SEQ ID NO: 331711 - DNA, 562 bp, Homo sapiens
  misc_feature: GZ8MTXP01BS9B9.21.81.H04.1.454.CMB.2.raw
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcatggaaccagcggtgacgttggtcttatgactatgtctctgtacaananaccaggacaaacgccccaaatcatcatttatgatgtacaagtaactccggtccctcgtaaggggtttctaatcgtcttctacgtcgctacagtctggaaccaaacncggccctacccngacctagtctcgtgggcctcgaggctcgaatgacgaggtctagtaattntactgcgtagggtctaataanacaatcanactaaactgttatgttccgttaggaactcgggaactaaagctacgtacgttcgttggttaccaacggaccccaaaggcccctaaaccttctaacgttccctaacc

SEQ ID NO: 331712 - DNA, 571 bp, Homo sapiens
  misc_feature: GZ8MTXP01AYF4K.21.81.H04.1.454.CMB.2.raw
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (366)..(366): a, c, t, g, unknown or other
  misc_feature (366)..(366): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaanacccaggacaaacgccccaaactcatcatttatgatgtacagtaatcggccctcgtaggggtttctaatcgcttctctcggctacaagtctggacaacncggcctcctgaccatctctgggctcgaggctgatgacgagctgtattatactgacgagggtctaatactacaatcagactaacgtacttaagtcgttcgttcgggaacttacggggacctaaggttactaccgtacccgttaccgttacggttaccaacggaccccaaacggccccaaaccccttacgttccgttccttaacccg

SEQ ID NO: 331713 - DNA, 674 bp, Homo sapiens
  misc_feature: GZ8MTXP01EFRI3.21.81.H04.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttangactatgtctctgtaccaacaacaccagacaaacgaccccaaatcatctattatgatgtacagtaacgtccgtaccctcgtaggggtttctaagtcgtcttctcgtcggcctactaagtcgtacggaacccaacgccggtccctacccgtacgacctactcgtcgtcgggcctcgacggtctgacgtgacggtagtctagtattacgtactgtaccgtagggtactaataactaactaaactcgaacgtacctaaacttacgtttacgtacggtttccggttaccggggaacgttacggggaaacctaaacggttaccgtaccggttaacccggttaccgttaacgggttaccctaacccgggaaaccccgtaaacccgggtaaccccccaaaaccccgttcggtttaacccgttaacccgtttaaccccg

SEQ ID NO: 331714 - DNA, 664 bp, Homo sapiens
  misc_feature: GZ8MTXP01B5I0U.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
  modified_base (451)..(451): a, c, t, g, unknown or other
  misc_feature (451)..(451): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaacgcccccaaactcatctatttatnatgtcagtaactcggtcccctcgtaggggttttctaattcgtcttctctcggcctacaagtctggacctacncggccctccctgacctatctcgtcgggtctccgaggtcctagacttggaacgngggtctaggtattacgtttacngtaccagggggttctaagttaactaaccgtaaacttcgaaacgtacctaaaaccttaaccgtttaacgtcgttaccgtttacgggggaaccgttaacggggaaaccctaaagttaccgtacccgtaacccggttacccgttacgggttaccaaccgaccccgtaaacgggccccctaaaacccccgttcgttaacgttaaccccgtaaccccg

SEQ ID NO: 331715 - DNA, 636 bp, Homo sapiens
  misc_feature: GZ8MTXP01CA19C.21.81.H04.1.454.CMB.2.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtnacgttgtctttangactatgtctcctggtaccaacaanacccaggcaaacgaccccaaactcatctatttatgatgtcagtaatcgccctcgtagggtttctaatcgtcttctctgctcagtctgacaacnccggcctccctgaccatctgtcgggctcgaggctgatgacgtaggctgtaattattacgtgacgtaggggtactaagttaactaactaatccaagacctaaaacctactttaacgtcggtttacccgttcgggggtaaccgttacgggggaaaccctaaaggttacttacccggtaaccccggttacccggttacggggttacccaaccgggtaccccccgaaacgggtcccccaaaacccccggttcgttaacccggttaacccttaaccccgg

SEQ ID NO: 331716 - DNA, 639 bp, Homo sapiens
  misc_feature: GZ8MTXP01A88KV.21.81.H04.1.454.CMB.2.raw
  modified_base (312)..(312): a, c, t, g, unknown or other
  misc_feature (312)..(312): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgtatccaccatctcctgcactggaaccaggtcggtgtacgttggttctttatgactatcgtctccgtgtaaccaacaacacccaggacaaacgaccccaaactcatctatttangatgtactaagtaacgtccggaccctgtacgggtttctaagtcgtcttctcgtcggcctacgaagtctacggaaccaaccgcccggtccctacccgtacgaaccctacttccgtcgtcgggtcctccgaggtcgtagactggaacggtagtctagtattaactacgtgtacgtaaggggtactaattaactaactaatcaagactaaactacttacgtacgttccgttacgggaacgtacgggaacctaaggttactaccgtaccgttaccgttcggttaccaaccgacccgaacgaccccaacccgttactccgttccttaacccg

SEQ ID NO: 331717 - DNA, 590 bp, Homo sapiens
  misc_feature: GZ8MTXP01D96QT.21.81.H04.1.454.CMB.2.raw
  modified_base (370)..(370): a, c, t, g, unknown or other
  misc_feature (370)..(370): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggaccaaacgacccccaaactcatcatttatgatgtcagtaatccggccctcgtaggggtttctaatcgtcttctctcggctcaagtctgacaacncggcctccctgaccatctcgtcgggcctccaggctgatgacgaggctgtattatactgcagggtcataatacaatcaagacaaactacttattcgtccgttacgggaacgttacggggaaacctaaagaccgtaccgtaacccgttaccgttacggttacccgaaccgaccccgaaaaccggtcccccaaaccccgttacttccgttaaccttaaccccg

SEQ ID NO: 331718 - DNA, 646 bp, Homo sapiens
  misc_feature: GZ8MTXP01EQI59.21.81.H04.1.454.CMB.2.raw
  modified_base (408)..(408): a, c, t, g, unknown or other
  misc_feature (408)..(408): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactattcgtctcctaggtaaccaaacaaactacccaaggaccaaacgacccccaaactcatactatttatgatgtactaagtaactccggacctcgtagggtttctaatcgtcttctctcggctacgagtctcggaacaaccgccggccctccctgaaccctnttccgtcgtcggggtccctacgacggtcgtacgagttggaacggtacggtctgtaatttactaccgtgaccgtaggggtactaattaactaacaatcgaacgactaaactactttaagttcgtacggtttacggggaacgttcgggaaacctaaagccgttaccgaacccgttaccgttaggacccgaaccgaccccgaaacggtacccccaacccttacgtcccgttaactaacccg

SEQ ID NO: 331719 - DNA, 547 bp, Homo sapiens
  misc_feature: GZ8MTXP01BD4WL.21.81.H04.1.454.CMB.2.raw
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (492)..(492): a, c, t, g, unknown or other
  misc_feature (492)..(492): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaanacccaggacaaacgccccaaactcatcatttatgatgtacagtaatcggccctcgtagggtttctatcgtcttctctcggctcaagtctggacaacgcgtccctccctgacctatctcgtcgggcctccgaggctgactgacggagtctagattattactgacaggggttcatatacatcatcaaactacttatcgttcgttcgggaactcgggaaccaaggntccacgttccgttacgggcaacggcccaacggcccaacccgactcgttcctaacc

SEQ ID NO: 331720 - DNA, 605 bp, Homo sapiens
  misc_feature: GZ8MTXP01AV5TS.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtcttatgactatgtctcctgtaccaacaacacccagacaaacgccccaaactcatctatttatgtatgtctaagtaacgtccggtccctacgtaaggggtttcctaatcgtcttctcgtcggcctacaagtctggaaccaaccgccggccctccctacgaccctactccgtcgtcgggcctccgaggtcctgactggacgagtctgtattatactgacgagggtcaagtactaacaatcaagtacctaaactacttagtcgtccgttacgggaacgtacgggaaccaacggactccgtaacccgttccgttacggttaccgaacgaccccgaacggtaccccaacccgttacttcgttaacctaacccg

SEQ ID NO: 331721 - DNA, 555 bp, Homo sapiens
  misc_feature: GZ8MTXP01ATQ4T.21.81.H04.1.454.CMB.2.raw
  modified_base (244)..(244): a, c, t, g, unknown or other
  misc_feature (244)..(244): n is a, c, g, or t
  modified_base (268)..(268): a, c, t, g, unknown or other
  misc_feature (268)..(268): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctgtaccaacaanacccaggacaaacgaccccaaactcatctatttatgatgtcagtaactcggccctcgtaggggtttctaatcgcttctctcgctcaagtctggacaacgcggcctccctgacctatctcgtcgggctccaggctaggatggacgagtctagattatactgacaggggtcatatacaatcaagacaaactacttatgttcgttcggggaactcggggaaccaagactccgtaaccgttccgttacggttccaacggaccccaaggccccaacccactcgttctaaccc

SEQ ID NO: 331722 - DNA, 606 bp, Homo sapiens
  misc_feature: GZ8MTXP01CVJ02.21.81.H04.1.454.CMB.2.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctctgcactggaaccngcggtgacgttgtcttangacttatgtctcctgtaccaacaataccaggacaaacgaccccaaactcatctatttangattgacagtaatcggcctcgtagggtttctaatcgtcttctcgtcggctacagtcgtcgaacaacncggcctcccagtaccatctcgtgggtcctcgaggtctgatacgacgaggctagtacttatacgttgacgtaggggtaccaagttaactaaaccattaccaacactaaacctactttagtacgttccggtcgggtaacgttacggaacgtaaacgcgttaaccacccggttaccgttggttaccaaccggaaccccaacgggaccccctaacccgttacttaaccggttaaccttaacccg

SEQ ID NO: 331723 - DNA, 563 bp, Homo sapiens
  misc_feature: GZ8MTXP01A57US.21.81.H04.1.454.CMB.2.raw
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcgaggggtttctaatcgcttctctcggctcaagtctggcaacncggcctccctgaccatcnctgggctccgaggctgatgacgaggctgattatactgacagggggtcaatatacaactcacgacaactaacttacgttacgttcgttcgggtaacgttacgggaccgtaaacgaacgtctaacccgttaccgttcgttacgaacggacccgaaccggacccaacccaacctcgttcgtaaccc

SEQ ID NO: 331724 - DNA, 542 bp, Homo sapiens
  misc_feature: GZ8MTXP01AT2LM.21.81.H04.1.454.CMB.2.raw
  modified_base (447)..(447): a, c, t, g, unknown or other
  misc_feature (447)..(447): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgccccaaactcatcatttatgatgtcagtaatcggccctctagggggtttctaatcgtcttctctcggctcgaagtctggacaacgccgcctccctgaccatctctgggcctcgaggctgatgacgagctgtattattactgtcaggggtctaatatacaatacganacaactacttatcgttcgttcgggaactagggacctaagctacgaccgttcgttaggttcaacgcccaacggcccaacccgactcgttctaaccc

SEQ ID NO: 331725 - DNA, 593 bp, Homo sapiens
  misc_feature: GZ8MTXP01DAUHY.21.81.H04.1.454.CMB.2.raw
  modified_base (243)..(243): a, c, t, g, unknown or other
  misc_feature (243)..(243): n is a, c, g, or t
  modified_base (373)..(373): a, c, t, g, unknown or other
  misc_feature (373)..(373): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttangactatgtctcctggtaccaacaatacccaggacaaacgcccccaaactcatcatttatgatgtacagtaactcggccctacgtagggtttctaatcgtcttctctcggctacaagtctggaaccaaacncggccctcccgtagacctactctacgtcgggccttccgaggtctagatggaacgtggctagtattattactgtaccaggggtacaagttaactacaaatcaagactaaactactttatcgtcgtttcggggaacttacgggaaccaaagataccgtacccgttacgttcggttacaaccgacccaacggaccccaacccttacgttcgttccgtaacccg

SEQ ID NO: 331726 - DNA, 615 bp, Homo sapiens
  misc_feature: GZ8MTXP01B8HRM.21.81.H04.1.454.CMB.2.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangacttatgtctcctggtaccaacaatacccaggacaaacgccccaaatcatcatttangatgcagtaatcggcctgagggtttctatcgtcttctctcggctcaagtctggacaacncggcctcccngaccatctcgtgggctcgaggctgagtgacgtaggtctagtaattattacgtgaccgtaggggtactaattaacaactaacttcgaacgtactaaactcttaacgttcgttaccgttacggggaaccgttcggggaaaccctaaacgggttcttacccggtaacccggttccgttaacgggttaccaacgggtaccccgtaaacgggaccccaaaccgttacccgtaaccgttcggttaaccccg

SEQ ID NO: 331727 - DNA, 581 bp, Homo sapiens
  misc_feature: GZ8MTXP01DQGTX.21.81.H04.1.454.CMB.2.raw
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
  modified_base (401)..(401): a, c, t, g, unknown or other
  misc_feature (401)..(401): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaaacaataccccaggcaaacgacccccaaactcatcatttangatgtcagtaatcggccctgtaggggtttctaatcgcttctctcggctcaagtctggaccaacncggcctccctagaccatctctgggctcgagcngatgacgagctagtattacttacgtgcgtaggggtactaatactaacaaattcaagactaaactacctttaagtcgtcgttcgggaacgttaggggaaccctaaaggactaccgtacccgttcgttacggttaccaacgacccgaacggaccccaacccttactcgttaaccgtaacccg

SEQ ID NO: 331728 - DNA, 583 bp, Homo sapiens
  misc_feature: GZ8MTXP01CGVBT.21.81.H04.1.454.CMB.2.raw
  modified_base (244)..(244): a, c, t, g, unknown or other
  misc_feature (244)..(244): n is a, c, g, or t
  modified_base (300)..(301): a, c, t, g, unknown or other
  misc_feature (300)..(301): n is a, c, g, or t
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatctctgcactggaaccagcggtgtacgttggtctttangactatgtctctggtaccaacaacaccaggacaaacgccccaaatcatctatttannatgtacagtaactcgacctgtagggtttctaatcgtcttctctcggctacaagtctggaacaacgccggtccctacctgaccctatctcgtcgggctccgaggctgatgacgagctgtattactacngctaggtctaatanacaatcaagtacaaactcttaatcgtcgttacgggaacgttacggaacaaagttaccgtacgtaccgttccgttacgggttacccaaccggaccccgaaaccggacccctaaacccgttacgttccgttcccgttaacccg

SEQ ID NO: 331729 - DNA, 554 bp, Homo sapiens
  misc_feature: GZ8MTXP01BUYJP.21.81.H04.1.454.CMB.2.raw
  modified_base (266)..(266): a, c, t, g, unknown or other
  misc_feature (266)..(266): n is a, c, g, or t
  modified_base (428)..(428): a, c, t, g, unknown or other
  misc_feature (428)..(428): n is a, c, g, or t
  modified_base (543)..(543): a, c, t, g, unknown or other
  misc_feature (543)..(543): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctggtacaacaanacccagacaaacgccccaaactcatcatttatgatgtcagtaatcggccctgtagggtttctaatcgtcttctctcggctcaagtctggacaaccgccggtcctccctagaccctatctcgtcgggcctcgaggtctggatggacgaggtctgtattatacngactaggggtcatactacaatcagacaactacttatcgtcgttcgggaacttgggaacctaagctaccgacccggttacgttacgttccgaacgaccccgaacggccccaacccnctcgttcctcc

SEQ ID NO: 331730 - DNA, 532 bp, Homo sapiens
  misc_feature: GZ8MTXP01BIXPU.21.81.H04.1.454.CMB.2.raw
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (449)..(450): a, c, t, g, unknown or other
  misc_feature (449)..(450): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (491)..(491): a, c, t, g, unknown or other
  misc_feature (491)..(491): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggacaaacgccccaaactcaatacatttatgatgtcagtaatccggtcctgtaggggtttctaatcgtcttctctcgctacaagtctggaccaaacgccggtccctccctgacctatctcgtcggctcgaggtctgatgacgngctgtattatacngcagggtcatananatcannaactntangtcgtggaactgggacctaagctcgacgttcgnggttacaacgacccaacggcccacccgctcgttctaacccg

SEQ ID NO: 331731 - DNA, 593 bp, Homo sapiens
  misc_feature: GZ8MTXP01C3T7M.21.81.H04.1.454.CMB.2.raw
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgcccccaaatcatcatttatgatgtcagtaatcggccctcgtaggggtttctaatcgcttctctcggctcagtctggaccaacncggcctcccgtgacctatctcgtcgggccttccgagggtctgatggaacggtagggtctaggtaatttattacgtgtaccgtaggggtacaattaataactaaagtacaagacctaaactactttatcggttcgttcggggaacttggggaaacctaaaggactaccgaccgttacgttcggttaccaacgaccccgaaggccccaaccccacgttcgttcttaacccc

SEQ ID NO: 331732 - DNA, 571 bp, Homo sapiens
  misc_feature: GZ8MTXP01B0B9W.21.81.H04.1.454.CMB.2.raw
  modified_base (363)..(363): a, c, t, g, unknown or other
  misc_feature (363)..(363): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcgaggggtttctaatcgcttctctcggctcaagtctggacaacncggccctccctgaccatctcgtgggctcgaggctgagtgacgaggctagacttattactgacctaggggtcaaagttactaacaaatccaagacctaaactactttagtcgttccttcgggggaacttggggaaccctaaagactccgaacccgttccgttaggttccaacgaccccgaacggcccaaccccgttatccgttctaacc

SEQ ID NO: 331733 - DNA, 583 bp, Homo sapiens
  misc_feature: GZ8MTXP01EZBIP.21.81.H04.1.454.CMB.2.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (366)..(366): a, c, t, g, unknown or other
  misc_feature (366)..(366): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgcccccaaactcatcatttangatgtcagtaatcggccctcgtaggggtttctaatcgtcttctctcgctcaagtctggacaacncggccctccctgacctatctcgtcgggcctcaggctgatgacgaggtctagtattatatgcgtaggggtctaataactacaaatcagtacaaacctacttaatcgttccgttcggggaacttacggggaaccaaaggttactaccgtaacccgttaccgttcgggttaccaacggacccaaacgggaccccaaccccgttactccgttcctaacccg

SEQ ID NO: 331734 - DNA, 580 bp, Homo sapiens
  misc_feature: GZ8MTXP01A8YJL.21.81.H04.1.454.CMB.2.raw
  modified_base (427)..(427): a, c, t, g, unknown or other
  misc_feature (427)..(427): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgccccaaactcatcatttatgatgtcagtaatccgggcccctcgagggggtttctaatcgcttctctcggctcaagtctggacaacgcgtcctccctgacctatctcgtcgggctccaggctgatgacgaggctagattattacgngtacgacgggtactaataactaacaactacaacgactaaactacgttagtcgttccgttacgggaacgtacgggaacaaacgacgtaccgacccgttccgttacggaccgaaccgaccccgaacgacccctaaccccacgtccgccgtaaccg

SEQ ID NO: 331735 - DNA, 591 bp, Homo sapiens
  misc_feature: GZ8MTXP01EQ2AC.21.81.H04.1.454.CMB.2.raw
  modified_base (366)..(366): a, c, t, g, unknown or other
  misc_feature (366)..(366): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctggtaccaacaatacccaggacaaacgaccccaaactcatcatttatgatgtcagtaactcggcctcgtaggggtttctaatcgtcttctctcgctcaagtctggacaacncggcctcctgaccatctctcgggctccgaggtctgactgacgaggtctagtattatactgctaggggtctaattaataacaactcaacgtctaaactatttatgttcgttacgggaacttggggaaaccctaaaggttactaccgtaacccgttccgttaacggttaccgaaccgaccccgaaacgggacccccaaaaccccttcttaaccggttcttaaccccg

SEQ ID NO: 331736 - DNA, 569 bp, Homo sapiens
  misc_feature: GZ8MTXP01EQY1Y.21.81.H04.1.454.CMB.2.raw
  modified_base (267)..(267): a, c, t, g, unknown or other
  misc_feature (267)..(267): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctgtaccaacaanacccaggacaaacgacccccaaactcatctatttatgatgtcagtaatcggcctcgtagggtttactaatcgcttctctcggcctcaagtctggacaacnccggccctcccngaccatctcgtcgggctcgaggctgatgacgagctagattatactgctaggggtactaattaataacaatcaacgtacaaactcttaatggtaccgttcgggtaactggggaaacctaaagactaccgtaaccgttccgttaggccgaacgaccccgaacggaccccaaacccgactcgttccttaaccc

SEQ ID NO: 331737 - DNA, 595 bp, Homo sapiens
  misc_feature: GZ8MTXP01EYIQ4.21.81.H04.1.454.CMB.2.raw
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (443)..(443): a, c, t, g, unknown or other
  misc_feature (443)..(443): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctgtaccaacaanaccaggacaaacgccccaaactcatcatttatgatgtcagtaatcggccctcgtaggggtttctaatcgtcttctctcggctacaagtctacggaccaacgccggccctcctgaccatctctcgggctcgaggctgatgacgaggtctagattatactgacaggggtactaattanaacaaatcaagactaaactactttagtcggttcgtcggggaacttcggggaaaccaaagttacgtaccgtaacccgttaccgttacgggttaccaacccggaccccgaaaccgggaccccctaaacccccgacttccggttaacctaacccg

SEQ ID NO: 331738 - DNA, 558 bp, Homo sapiens
  misc_feature: GZ8MTXP01ALLCK.21.81.H04.1.454.CMB.2.raw
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
  modified_base (445)..(445): a, c, t, g, unknown or other
  misc_feature (445)..(445): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaacgccccaaactcatcatttatgatgtcagtaatcggccctctagggggttttctaatcgcttctctggcctcaagtctggacaacncggcctccctgaccctatctctgggcctcaggctggactgacgagctgattatactgcaggggttcatatacaatcancaaactacttatacgttcgttaccggggaacgtggggttaacccaaggactccgaccggttcgttacggttacaacggacccaacgggacccaaccccgacctcgctaacccg

SEQ ID NO: 331739 - DNA, 606 bp, Homo sapiens
  misc_feature: GZ8MTXP01CEU4L.21.81.H04.1.454.CMB.2.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaaacgccccaaactcatctatttangatgtctaagtaatcggcctcgtagggggtttctaattcgcttctctcggcctacgaagtcgtaggaacaacgaaccggccctcccgtagacctatccgtcgtcgggcctccgaggtctgactgacggaggtctagtattactcgtagctaagggtctaattaacaacaatacacgactaaactacgttaagtcgtttacgtacggggtaactcgggttaaacaaaggacttacgtacccgttacgttacgttaccgaaccgaccccgaacggaccccaaacccgacttaaccgccttaacccg

SEQ ID NO: 331740 - DNA, 571 bp, Homo sapiens
  misc_feature: GZ8MTXP01ES931.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaacgaccccaaactcatcatttatgatgtacagtaatcggccctcgtagggtttctaatcgtcttctcgtcggctacaagtctggacaacgcggcctccctgacctatctcgtgggcctcgagctgatgacgagtctgtattatactgacagggtctaagtatacaatcagacaaactcttaatcgtcgttcgggaactagggaacctaaagttactaccgtacccgttacgttcggttaccaaccgaccccgtaaaccggaccccaaacccgttacgtcgttccgtaacccg

SEQ ID NO: 331741 - DNA, 619 bp, Homo sapiens
  misc_feature: GZ8MTXP01EANS7.21.81.H04.1.454.CMB.2.raw
  modified_base (272)..(272): a, c, t, g, unknown or other
  misc_feature (272)..(272): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggttctttatgactattgtctcctggtaccaacaanacccaggacaaacgccccaaactcatcatttatgatgtcagtaatccggtccctacgtaggggtttctaattcgtcttctctcggcctacaagtcnggaaccaacncggccctcccgtcgacctatcctcgtcgggctcgagctgatggacgngctagtattatacgngacgtagggtacaattaactaacaaatcgaacgactaaactaacgtttactcggttccgttccgggtaacgttacgggggaaacctaaagggttacctaccgtaacccggttacgttacggacccaaccggacccctaaacgggcccccaaccccgttattcccgttaacttaaccccg

SEQ ID NO: 331742 - DNA, 631 bp, Homo sapiens
  misc_feature: GZ8MTXP01C76EB.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttggtctttangactntgtctcctggtaccaacaatacccagacaaacgaccccaaactcatacatttatgatgtacagtaatccggccctcgtagggggtttctaatcgtcttctctcggctcaagtcnggacaacncggccctccctcgaccatctctcgggctccaggctgatgacgaggctagattattaacgtcgcgtaggggtctaattaactaacaaattaccaacgacctaaaacctacgtttaacgtcgtttccgtttacgggggaaccgttacgggggaaaccctaaagggttaaccttaccgtaccccgttacccgtttaacggggacccaacggaccccgaaacgggaccccctaacccccgaacttccgttaacccgttaaccccg

SEQ ID NO: 331743 - DNA, 573 bp, Homo sapiens
  misc_feature: GZ8MTXP01BR1X0.21.81.H04.1.454.CMB.2.raw
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccagcggtgacgttggtcttatgactatgtctctgtaccaacaanaccaggacaaacgccccaaactcatctatttangatgtcagtaatcggccctgtagggtttctaagtcgtnttctctcgctacaagtctgacacncggcctccctgacctatctcgtcgggctccgaggctgatgacgngctgattatangcgaggtcatatacaatcagactaaactacttagtcgtcgtcgggaacttacgggaaacctaagttaccgtaccgtaacccggttaccgttacgggttacccaaccggaccccgaacggacccccaaaccccgttacgtaaccggttccctaaccccg

SEQ ID NO: 331744 - DNA, 808 bp, Homo sapiens
  misc_feature: GZ8MTXP01BVZ9H.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
  modified_base (767)..(767): a, c, t, g, unknown or other
  misc_feature (767)..(767): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctgtaccaacaanacccaggacaaacgccccaaactcacctatttangatgtcagtaactcggccctcgtaggggtttctaacgtcgtcttctcgtcggtccctaccgaagtctacgggacctaaaaccgacccgggtcccttacccgtacggtaacccctacgttccgtccggtcgggggacccttacccggaacgggttccgtaggtaacgttacgggaaccggtaacggggtccttaaggttaacttttaacgttaacgtggtaaccgtaacgggttaccgtaaatttaaacgttaaaccgtaaacttaccgaaacggtaaccctaaaacttaacccgttttaagttaccgggtttacccgtttaaccgggggaaccgttaacgggggtaaacccttaaagggtaacccttacccggtaaaccccggtttacccggttaacggggttacccgaacccgggtaacccccggtaaaacccggggaaccccccttaaaaacccccccgggtntttaaccccggttaaccccttaaaccccggtttttcccccg

SEQ ID NO: 331745 - DNA, 532 bp, Homo sapiens
  misc_feature: GZ8MTXP01DA0QG.21.81.H04.1.454.CMB.2.raw
  modified_base (242)..(242): a, c, t, g, unknown or other
  misc_feature (242)..(242): n is a, c, g, or t
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctctgcactggaaccagcggtgacgttggtctttangactatgtctctggtacaacaataccaggcaaacgccccaaactcatcatttatgatgtcagtaatcggccctcgtaggggtttctaatcgcttctctggctcaagtctggacaacncggcctcctgaccatctcgtgggctcaggctgatgacgnggctgattatctgcagggtcatatacaatcagcaaactcttatcgtcgttcgggaacttagggaccctaaaggactaccaccgttaccgttaggttaccaagacccaacgggcccaacccacgtcgctaacccg

SEQ ID NO: 331746 - DNA, 643 bp, Homo sapiens
  misc_feature: GZ8MTXP01CYX5Y.21.81.H04.1.454.CMB.2.raw
  modified_base (246)..(246): a, c, t, g, unknown or other
  misc_feature (246)..(246): n is a, c, g, or t
  modified_base (306)..(306): a, c, t, g, unknown or other
  misc_feature (306)..(306): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggcggtgtacgttggtctttangactatgtctcctaggtaccaaacaactaccaggacaaacgccccaaatcatctatttangatgtacaagtaactcggccctagtagggtttctaatcgtcttctctcggcctacgaagtctggaaccaacgccggccctccctagaccactctcgtcgggctcgagctagatggacgaggctagtaattacgttaactgactaggggttacaaattaactaaccaaagttccgaaagtacctaaaacttaccgttaagtcgtttacccggtaacggggtaaccttacgggggaaaccctaaaggttacctaccgtaaccccggttaccgttacgggttaccaaccgaaccccgtaaacggacccccaaaacccgttcgttcgaaccctttaacccg

SEQ ID NO: 331747 - DNA, 722 bp, Homo sapiens
  misc_feature: GZ8MTXP01A46XX.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (370)..(370): a, c, t, g, unknown or other
  misc_feature (370)..(370): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctgtaccaacaactaccaggacaaacgccccaaactcatctatttatgatgtcagtaatccggcctcgtagggtttctaagtcgtcttctctcggcctacaagtctcggaccaacnccggcctccctgaccctatcctcgtcgggccctaccgagggtctcgtagtaggaaccggtagggtacttagggtaactttacgttaaccgtcgggtacccgtaagggggtttacctaaagttaaacttaaacctaaacgttaccaacggtaaaccctaaaaccttaaccgttttaacgttccgggtttaccgttttaaccgggggaaccgtttaaccgggggaaccctaaaacgggttaacctacccgttaaaccccgggttccgttaaacgggttacccgaacccgggtaaccccgtaaaccgggaaccccctaaaccccggttaccttaacccggttcccgttaaccccg

SEQ ID NO: 331748 - DNA, 570 bp, Homo sapiens
  misc_feature: GZ8MTXP01AH4VD.21.81.H04.1.454.CMB.2.raw
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaaccaacaatacccaggacaaacgcccccaaactcatcatttatgatgtcagtaatcggcctcgtaggggtttctaatcgtcttctctcgctcaagtctgacaacncgcctccngaccntctctggcctcgaggctgatgacgnggctagtattatactgcagggtcaatataacaatcagacctaaactacttagtcgttaccgtcggggaactacggggaaaccaaagacgtaccgtaacccgttcgttacgggacccaacgaccccgaaacggacccccaaaccccgttactccggttcctaacccg

SEQ ID NO: 331749 - DNA, 573 bp, Homo sapiens
  misc_feature: GZ8MTXP01AHT6R.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (268)..(268): a, c, t, g, unknown or other
  misc_feature (268)..(268): n is a, c, g, or t
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaanacccaggcaaacgccccaaactcatcatttatgatgtcagtaatccggcctcgtaggggtttctaatcgtcttctctcggctacagtctggaacaacgccggcctcccgtgaccatcctcgtcgggcctccgaggctgactggacgnggtctggtattattacngcgagggtcattanaacaatcaagactaaactactttagtcgttcgtacggggaactaggggaacctaagttactccgaaccgttcgttacggttccaacgacccaacggtccccaacccgttacgtccgttcctaacccg

SEQ ID NO: 331750 - DNA, 566 bp, Homo sapiens
  misc_feature: GZ8MTXP01EX21X.21.81.H04.1.454.CMB.2.raw
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctgtaccaacaanaccaggacaaacgaccccaaactcatcatttangatgtcagtaatcggccctcgtagggtttctaatcgtcttctctcgctcaagtctggacaacncggccctccctcgacctatctcgtcgggcctccgacggctgatgacggagtctgattatactgctaggggtactatataactaatacaagactaaactacttagtgttccgttcgggaactacgggaaccaaaggttactaccgtaaccgttacgttacggttccaacgacccaaacggccccaacccactcgttaacctccg

SEQ ID NO: 331751 - DNA, 556 bp, Homo sapiens
  misc_feature: GZ8MTXP01AY5D5.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccngcggtgacgttggtctttangactatcgtctcctggtaccaacaatacccaggacaaacgccccaaactcatcatttangatgtcagtatcgcctgtagggtttcaatcgcttctctcgctcaagtctgacacncgcctccnaccatcnctggctcagctgatgacgaggctagattatacngtacgagggtacattacaactaatcgagacaaactactttacgtgttaccgttcgggaacttcggggaaccctaaggttactaccgtaccgttaccgttcgggttaccaagaccccaacggaccccaacccggacttccgttctaaccccg

SEQ ID NO: 331752 - DNA, 621 bp, Homo sapiens
  misc_feature: GZ8MTXP01EH90L.21.81.H04.1.454.CMB.2.raw
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcacatctcctgcactggaaccagcggtgacgttgtacttangactatgtctcctaggtaaccaaacaacaccagaccaaaacgaccccaaatcatactatttangatgtactaagtaacgtccggtaccctacgttaacggggtttactaaattccgtctttcnccgttacggcctactaagtcgtacggaaacccaaacgccggtccctacccgtacaccctatccgtcgtgggtcctccgagtctagagtacgacgtaggtctagtattataacgtgtcgaagggttanaaatttaanaactaaatcaacgactaaactattacgtggttccgtagggtaacgtagggaaacctaaagttactacctaccgttacgttaggaccaacgaccgaacgtacccaccttatcgttaactccg

SEQ ID NO: 331753 - DNA, 621 bp, Homo sapiens
  misc_feature: GZ8MTXP01EF9HE.21.81.H04.1.454.CMB.2.raw
  modified_base (244)..(244): a, c, t, g, unknown or other
  misc_feature (244)..(244): n is a, c, g, or t
  modified_base (423)..(423): a, c, t, g, unknown or other
  misc_feature (423)..(423): n is a, c, g, or t
  modified_base (471)..(471): a, c, t, g, unknown or other
  misc_feature (471)..(471): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaaacaactaccaggacaaacgaccccaaatcatcatttatgatgtcaagtaactccggcctacgtagggggtttctaatcgtcttctctcggctacaagtctaggaccaacgcggcctccctgacctatcctcgtcgggcctccgaggctgagtggaacgnggtctgtaattactaacgtcgactaggggtacaattaataacaatcanacctaaactcttagtcgtcgttcggggaacgttcgggaaactaacggacttaccgtaacccgggttccttaacggggttacccgaacccgggaccccgtaaacggggacccccaaacccttacccgttaacggttaacccgttaaccccg

SEQ ID NO: 331754 - DNA, 601 bp, Homo sapiens
  misc_feature: GZ8MTXP01D7UAE.21.81.H04.1.454.CMB.2.raw
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcggtgacgttggtcttatgactatgtctcctggtaccaaacaatacccaggacaaacgaccccaaactcatcatttatgatgtcagtaatcggcctcgtagggtttctaatcgtcttctctcgctacaagtctggacaacncggcctcccngaccatctcgtgggcctcgaggctgatggaacgnggtactgtaattactactgaccagggtacaattaactaacaaatcaagactaaaccttactaattcgttccgttacggggtaacttcgggaaacctaaacggttactacccgtaaccggttaccgttaacggttcccgaaccgaccccgaacggacccccaaaccccttaccgtaacgttaacccgtaaccc

SEQ ID NO: 331755 - DNA, 562 bp, Homo sapiens
  misc_feature: GZ8MTXP01B65OT.21.81.H04.1.454.CMB.2.raw
  modified_base (369)..(369): a, c, t, g, unknown or other
  misc_feature (369)..(369): n is a, c, g, or t
  modified_base (407)..(407): a, c, t, g, unknown or other
  misc_feature (407)..(407): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatcgtctcctggtaccaacaatacccaggacaaacgccccaaactcatcatttatgatgtcagtaatccggccctcgtaggggtttctaatcgtcttctctcggctcaagtctggacaacncgccctcctgaccatctctgggctcaggctgatgacgnggctagtattatactgactagggtctaatactacaatcaagactaactattgttacggtcctttcggggaacttacggggaaccaagttacgtacgtacccgttcgttaggttccaacggcccgaacggccccaacccgactccgttctaacccg

SEQ ID NO: 331756 - DNA, 581 bp, Homo sapiens
  misc_feature: GZ8MTXP01AEALS.21.81.H04.1.454.CMB.2.raw
  modified_base (375)..(375): a, c, t, g, unknown or other
  misc_feature (375)..(375): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggtctttatgactatgtctcctggtaaccaacaacacccaggaccaaacgacccccaaaactcaatctatttatgtatgtacagtaactccggccctcgtaaggggttttctaagtcgtcttctctcggcctacagtcnggaacaaccgccgccctccctgacctatcgtcgtcgggcctcgaggctgatgacgacgtctagtacttattacgtagcgtaagggtctaattaacaactaactcgaagactaactacttagtcgtcgttcggaacgtcgggaacagacgtcctacgttcgacggttcaaccggaccaaccgacccaacccttacgtcgctaacccg

SEQ ID NO: 331757 - DNA, 594 bp, Homo sapiens
  misc_feature: GZ8MTXP01A6GFF.21.81.H04.1.454.CMB.2.raw
  modified_base (244)..(244): a, c, t, g, unknown or other
  misc_feature (244)..(244): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaactacccaggacaaacgcccccaaactcatctatttatgatgtcagtaatcggcctcgtaggggtttctaatcgtcttctctcggctcagtctggacaacnccgcctcccncgaccatctcgtcgggctcgaggtctgatgacgaggctagtattattacgtgacgtaggggtactaattataactaatacaacgacctaaactaccgtttaagtcgttaccggtttaccgggaacgttacggggaacctaaaggactaccgtaacccgttcgttacggttaccaaccgacccgaacggaccccaaccccgactccgttctaacccc

SEQ ID NO: 331758 - DNA, 731 bp, Homo sapiens
  misc_feature: GZ8MTXP01EI5JU.21.81.H04.1.454.CMB.2.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (384)..(384): a, c, t, g, unknown or other
  misc_feature (384)..(384): n is a, c, g, or t
tcagtcgtcgctcgcacgaccggtgctcgatttagtagtgtagattcgcgggggggtctcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtnacgttggtcttttaangacttatcgtctactgtaaccaacaanacccaggcaaacgccccaaatcatctaatttangtatgtacaagtaactccggtaccctagtagggtttctaatccgacttcgtctcggctacgaagtctagaaaccaacnccggtcctcccgtagaaccctacttccgtcgtcgggtcctaccgagggtccttagaagtcggaaacggtcggtactaggttaacttaaacttaccgtagtaccgtaagggggtttacctaaagtttaaacttaacctaaacgttaacccaaggtaaccttaaaaaacccgttaccttttaaaggtttccggtttaccgtttaccgggggtaacgtttaacgggggaaacccctaaagggttactaaccccgggtaaccgtttacccgttacggggttaccaacccggggtaccccaaacgggttacccccaaaaccccgttcgttaacccgttaacccgtaaccccg

SEQ ID NO: 331759 - DNA, 569 bp, Homo sapiens
  misc_feature: GZ8MTXP01BIKRU.21.81.H04.1.454.CMB.2.raw
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgacgttggtctttatgactatgtctcctggtaccaacaatacccaggcaaacgcccccaaactcatcatttangatgtcagtaatcggcctcgaggggtttctaatcgtcttctctcggctcaagtctggaacaacncggcctccctgacctagtctcgtcgggctccgaggctagatgacgaggctagattactatgcaggggtctattaactacaagtacatacaaacctntttaangttccgttcgggcttacggggacaaggttactcgaaccgttccgttaggttccaacgaccccaacggaccccaaccccttacgttcgttaaccgtaaccc

SEQ ID NO: 331760 - DNA, 566 bp, Homo sapiens
  misc_feature: GZ8MTXP01AVRQ8.21.81.H04.1.454.CMB.2.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (301)..(301): a, c, t, g, unknown or other
  misc_feature (301)..(301): n is a, c, g, or t
  modified_base (453)..(453): a, c, t, g, unknown or other
  misc_feature (453)..(453): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtactttangactatgtctcctgtaccaacaanacccaggacaaacgccccaaatcatcatttangatgtacagtaatcggccctgtaggggtttactaatcgtcttctactcggctcgaagtcgtggaaccaacgccggccctcccgtacgaacctatctctgggtctaccaggctgatcgaacggagtctagaatttatactgacagggtcatanacaatcaagcaaactacgttatgtacgttgggaacgtacggactaaagctaccgacccggttacgttgggccaacgacccaacggaccccaacccgttactcgttcctaaccc

SEQ ID NO: 331761 - DNA, 695 bp, Homo sapiens
  misc_feature: GZ8MTXP01AM5C8.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttgtcttatgactatgtctccgtaggtaccaacaatacccaggacaaacgccccaaatcatactatttatgatgtacagtaactccggcctagtacggggtttctaagtcgtcttctcgtcggcctacaagtctaggaacaacgccggtccctccctacgacctattcgtcgtcgggtcctccgagggtcctaggagtcggaacgtacgggtcttaggtaaatttacgttaacgtgtaccgtaaggggtactaagtttaacaacctaaattccgaaacgtaaacccttaaaacttaccgttttaagtaccggttttaccggtttaccgggggaaacgttaccgggggttaaacctaaacggttccttaacccggtaacccggttacccgttacgggttccaaacccgggtccccaaaccgggaccccctaaaccccttggtaacccgttccgttaaccccg

SEQ ID NO: 331762 - DNA, 681 bp, Homo sapiens
  misc_feature: GZ8MTXP01AVD57.21.81.H04.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctaggtaccaacaactacccaggacaaacgaccccaaactcatactatttatgatgtacagtaatccggcctcgtaggggtttactatcgtcttctctcggctcgaagtctaggaacaaccgaaccggccctaccctcgaccctattccgtacgtcgggccttccgaggcctaggagtcggaacggacggtctaggtaaactttattacttgtacgtaacgggggttactaacgttaataaacctaaagttaccgaaacgtactaaacctacgtttaaactcggttaccgttacggggtaaccgttaacgggaaaccgtaaacggaccttacccgtaaccccggttaccgttaacgggttacccgtaaacggacccccgaaaccgggaccccctaaaaccccggttactaaccggtttccctaacccg

SEQ ID NO: 331763 - DNA, 580 bp, Homo sapiens
  misc_feature: GZ8MTXP01D1E98.21.81.H04.1.454.CMB.2.raw
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggacaaacgcccccaaactcatcatttatgatgtacagtaactcggccctcgtaggggtttctaattcgcttctctcggctcaagtctggaacaacncggcctcctgaccatctcgtcgggctccgaggctgatgacgnggctgattatactgacaggggtactaatataacaatcaagtactaactacttaatcgttcgttacgggaacgttaggggaaccctaaaggactaccgtaacccgttaccgttaggttaccaacggaccccaaacggccccaaacccgttactcgttaacctaacccg

SEQ ID NO: 331764 - DNA, 652 bp, Homo sapiens
  misc_feature: GZ8MTXP01AUFDK.21.81.H04.1.454.CMB.2.raw
  modified_base (340)..(340): a, c, t, g, unknown or other
  misc_feature (340)..(340): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctgtaccaacaataccaggcaaacgccccaaactcatctatttatgatgtcagtaactcggcctgtagggtttctaatcgcttcnctcgctcaagtctcggaacaacgcgcctccctcgacctatctcgtcgggctcgaggctgagtagacgaggtctagtattaagtactgaccgtaggggtactaagttaactaactaaacttacgaaacgacctaaaaccttacgtttaacttcgggttaccgtttaccggggtaaccgttacgggggaaacctaaacggttaccgttacccgtaacccgggttacccgttacgggttaacccgaacccggaaccccgaaaaccggggtaccccccaaaccccggttacctttccggttaaccccgttaacccg

SEQ ID NO: 331765 - DNA, 556 bp, Homo sapiens
  misc_feature: GZ8MTXP01C203O.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (397)..(397): a, c, t, g, unknown or other
  misc_feature (397)..(397): n is a, c, g, or t
  modified_base (454)..(454): a, c, t, g, unknown or other
  misc_feature (454)..(454): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgtacgttggtcttangactatgtctcctggtaccaacaacaccaggacaaacgaccccaaactcatactatttatgatgtcaagtaactcggtcctacgtagggttactatcgtcttctctcgctacagtctgacacgccgcctcctgacctatcctcgtcggctacgnggtctgatgacgtgtctgattatacgagtctaggtcatataacatcagtactaactnttaatgtcgtcggtaacgtacggaacgtacgacgttacccgtacgttaccgttcgaccgccgaacccaaccggacccctaaccaccgttcgttcctaacccg

SEQ ID NO: 331766 - DNA, 644 bp, Homo sapiens
  misc_feature: GZ8MTXP01B69OL.21.81.H04.1.454.CMB.2.raw
  modified_base (300)..(300): a, c, t, g, unknown or other
  misc_feature (300)..(300): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctgtaccaacaacaccaggacaaacgccccaaactcatcatttangatgtacagtaactccggtccctagtacgggtttactaagttcgtcttctctcggcctacgtaagtcctaggaacctaacgcccggtccctacccgtacgtacctacgttcgtcgtcgggtccttccgagtccgtagatcggaacgaggtcttagtacttagttacgtgtaccgtaggggtactaattaactaactaaatccgaaacaaaccttaaacttacgttacgttcgttaccggtcgggtaacgtacgggaactaaacgttccgtaccgtacccgttcgttacgttaccaaccgtacccgaaccggacccctaacccttcgttaaccgttccttaaccg

SEQ ID NO: 331767 - DNA, 591 bp, Homo sapiens
  misc_feature: GZ8MTXP01CTVHT.21.81.H04.1.454.CMB.2.raw
  modified_base (240)..(240): a, c, t, g, unknown or other
  misc_feature (240)..(240): n is a, c, g, or t
  modified_base (302)..(302): a, c, t, g, unknown or other
  misc_feature (302)..(302): n is a, c, g, or t
  modified_base (453)..(453): a, c, t, g, unknown or other
  misc_feature (453)..(453): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctctgcactggaaccagcggtgacgttgtcttangactatgtctccgtaggtaaccaacaacacccaggacaaacgaccccaaatcatctatttangatgtacagtaactcggcctgtacgggtttctaatcgtcttctctcggtcctacgaagtctacggaacctaaccgaaccggtccctacccgtagaaccctcttccgtcgtcgggctacgaggctgatcggacgaggtctagtattatacgngtcaggggtactaattaactaacaaagtcaacgactaaacctattatcgtacgttacggaactagggaactaagactaccgaccgttcgttaggaccaacgaacccaacggtacccaaaccgttctcgttcctaaccg

SEQ ID NO: 331768 - DNA, 764 bp, Homo sapiens
  misc_feature: GZ8MTXP01CHEP3.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccngcggtgacgttggtctttangactatcgtctctgtaccaacaanaccaggacaaacgaccccaaactcatcatttatgatgtcaagttaactccggtccctacgtagggggtttactaacgttcgtctttctacgttcggtaccttaccgtaaagttcccgtagggaaccctaaacccgtaacccgggtccccttaccccgttacggaacccctaacgttcccgttcggttaccgggggtcccttacccgaagggtcccgttaggtaacgttacgggaaaccgggtaacgggttaccgttacggttaaatttaacgtttaaacgttcggacccgttaagggggttacctaaatttaactaaactaaacttaccgaaacgtaaccttaaaacttacctttaagttaccgtttaccggttaacggggtaacgtacggggttaaacctaaaggttacctaccgtaacccggttaccgttaacggttacccgaacgaccccgaacccggaaccctaaccccggactttccgaaccgtttaaccccg

SEQ ID NO: 331769 - DNA, 546 bp, Homo sapiens
  misc_feature: GZ8MTXP01EZSVA.21.81.H04.1.454.CMB.2.raw
  modified_base (397)..(397): a, c, t, g, unknown or other
  misc_feature (397)..(397): n is a, c, g, or t
  modified_base (512)..(512): a, c, t, g, unknown or other
  misc_feature (512)..(512): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgacctcaccactctcctgcgcctggaaccgagcggtgtacgttgtcttatgtactactcgtctacctacgtaccaacaacaccaacgaccaaacgaccccaaactctatactattatgatagtcacgtacgtcgtcctacgtacggttactactctctcctctgctacacgtacgtcgcaccaccgccctccactcacnctctcgtcgtcgcgcgacgtagacgtacgacgtacgtcgtagtacttacttacgacgacgtacgtactactacacacacactactactacgtagtcgtcgttacgtcgacgacgncacgccaacggcaacgccacgccaacccgcctcg

SEQ ID NO: 331770 - DNA, 531 bp, Homo sapiens
  misc_feature: GZ8MTXP01ADA68.21.81.H04.1.454.CMB.2.raw
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
  modified_base (494)..(494): a, c, t, g, unknown or other
  misc_feature (494)..(494): n is a, c, g, or t
  modified_base (519)..(519): a, c, t, g, unknown or other
  misc_feature (519)..(519): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaaagcccccaaactcatcatttatgatgtcagtaatcggccctcgagggggtttctaatcgcttctctcggctcaagtctggacaacncggccctaccctgacccatctctgggctcccgaggactgatgacgngggctgattatactgcaggggtcatatacaatcagcaaacacttatacgtcttcgggaactgggaccaagactcacgttccnggttcaagcccaaggtcccaacccnctcgttctaacg

SEQ ID NO: 331771 - DNA, 686 bp, Homo sapiens
  misc_feature: GZ8MTXP01A8LWY.21.81.H04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtcttangactatgtctcctaggtaccaacaatacccaggacaaacgccccaaactcatctatttatgatgtacagtaactccggccctcgtaggggttttctaagttcgtcttctcgtcggcctcaagtctggaaccaacnccggccctcccngacctatctcgtcgggcctcgaggctgagtggacgaggctagtattacttacgtgactacggggtataactaacttaacgaaacttccgaaacgaccctaaaacgttaacctttaacgttcgggttacccgtttaccgggggaaacccgtttacgggggaaaaccctaaacgggttaccgttacccgtaaccccgggttacccgttaaacgggttcccgtaaacccgggacccccgtaaacccgggtaacccccaaacccccgggttaacttccgggtttaaccctaacccccggg

SEQ ID NO: 331772 - DNA, 589 bp, Homo sapiens
  misc_feature: GZ8MTXP01DLKFL.21.81.H04.1.454.CMB.2.raw
  modified_base (244)..(244): a, c, t, g, unknown or other
  misc_feature (244)..(244): n is a, c, g, or t
  modified_base (369)..(369): a, c, t, g, unknown or other
  misc_feature (369)..(369): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggacaaacgacccccaaactcatcatttatgatgtcagtaatcggccctcgtagggggtttctaatcgcttctctcggctcaagtctggcaacncggcctccctcgaccatctctgggctcgaggctgatgacgaggctagatttaatactagcgtaggggtactataataacgaatacagacaaactacttaattcgtcgttccggggaacttaggggaacctaaagacgttaccgacccgttacccgttagggttaccgaacgaccccgaaacgggtaccccaaaccccgttacgttccgttcctaaccccg

SEQ ID NO: 331773 - DNA, 644 bp, Homo sapiens
  misc_feature: GZ8MTXP01DBYS7.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (467)..(467): a, c, t, g, unknown or other
  misc_feature (467)..(467): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangaactatcgtctcctggtaccaacaaactacccaaggaccaaacgacccccaaaactcaatctaatttatcgaatgtacagttaactcggcctcgtaggggtttactaatcgtcttctctcggtcctcaaagtctacggaacaacgaaccggtccctccctacgaaccctatccgtcgcgggtctccgaggctagatggaacgaggtctagtattacgttacncgacgaggggtctaaataataacaaatccaagacctaaactactttaagtcgttacggttaccggggaacttacggggaaaccctaaaggttacttacccgtaaccggttacccgttagggttcccaaccgaccccgaaaccggaccccaaacccttccttaacgttccttaacccg

SEQ ID NO: 331774 - DNA, 570 bp, Homo sapiens
  misc_feature: GZ8MTXP01BCYPB.21.81.H04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtcttangactatgtctctgtacaacaanaccagacaacncccaaancatcatttangatgtcagtaactcggcctcgtagggtttctaatcgtcttntctcgctcaagtctggacaacncgcctccctgacctatctctcgggctaccgaggctgagtggacgtagctagtaattacgttactgtacgtacggggtactaagtactaactaatacagacctaaactaccttaagtcgttcggttacgggaacgtacggggttaaccaaggactaccgaccgttccgttacggttaccaacgacccgaacggacccacccatcgttaacctccg

SEQ ID NO: 331775 - DNA, 585 bp, Homo sapiens
  misc_feature: GZ8MTXP01ADEV8.21.81.H04.1.454.CMB.2.raw
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttatgactatgtctcctggtacaacaatacccaggacaaacgccccaaactcatcatttatnatgtacagtaactcggccctcgtaggggtttactaatcgcttcnctcggctcaagtctggacaacnccgcctccctgaccactcncgtcgggctccgngcngatgacggaggctagtatttacttacgtgtcgaggggtacaattaactaactaaacttcgaacacctaaactaccgttagtcgttaccgttcggggtaacgtaacggggaccaaagacgtccgaaccgttccgttagggttccaacgcccgaacgacccaaccccttacgtcgttctaacccg

SEQ ID NO: 331776 - DNA, 658 bp, Homo sapiens
  misc_feature: GZ8MTXP01A5QX4.21.81.H04.1.454.CMB.2.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
  modified_base (376)..(376): a, c, t, g, unknown or other
  misc_feature (376)..(376): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccngcggtnacgttggtctttatgacttatgtctcctggtaccaacaatacccaggacaaacgcccccaaactcatcatttatgatganagtaactcggccctcgtagggggtttctaatcgtcttctctcggccttacaagtctggaactaaccnccggcctccctcgacctactcctcgtcgggccttccgagggctagagtgaaccggtaggccttaggatttattacgtgaccgtaggggtctaaatataactaaactacaacgacctaaaactactttaactcggtttaccttacgggggtaacgttacgggggttaaacccaaaggttaaccgttaccgaacccggtttacccgttacgggttacccgaaccgaccccgaaaccgggtacccccaaaccccgttaacccttcggttaaccgtttaacccccg

SEQ ID NO: 331777 - DNA, 528 bp, Homo sapiens
  misc_feature: GZ8MTXP01DXLDY.21.81.H04.1.454.CMB.2.raw
  modified_base (365)..(365): a, c, t, g, unknown or other
  misc_feature (365)..(365): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaaactcatcatttatgatgtcagtaatcggccctcgtaggggtttctaatcgcttctctcggctcaagtctggcaacncggcctccctgaccatctctgggctcgaggctgatgacgaggctgattatactgcaggggtcatatacaatcagcaaactcttatgtcttcggggaactggggaccaagatcacccgttcgttggttccaagcccaacggcccaaccccgatcgttctaaccc

SEQ ID NO: 331778 - DNA, 552 bp, Homo sapiens
  misc_feature: GZ8MTXP01BT9W5.21.81.H04.1.454.CMB.2.raw
  modified_base (243)..(243): a, c, t, g, unknown or other
  misc_feature (243)..(243): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgcccccaaactcatctatttatgatgtcagtaatcggcctcgtagggtttctaatcgtcttctctcggctcaagtctcggaacaacncggcctcctgaccatctctgggcctcgaggtctgatgacgaggctagattatacngcagggtcatatacaatcagacaaactcttntcgtacgttcgggaactgggaccaaagactcctaaccgttaccgttggttaccgaacgtaccccgaaacggtccccaaccccatccgttaactaacccg

SEQ ID NO: 331779 - DNA, 686 bp, Homo sapiens
  misc_feature: GZ8MTXP01EP9X3.21.81.H04.1.454.CMB.2.raw
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
  modified_base (462)..(462): a, c, t, g, unknown or other
  misc_feature (462)..(462): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggtcttangactatgtctccgtaggtaaccaaacaactacccaggacaaaccgaccccaaatcatactatttangtatgtacaagtaactccggtacctagtagggtttactaattcgtcttctcgtcggcctacgtaagtctacggaaccaacgtccggtccctacccgtcgaaccctcgttccgtcggtcgggtcctacgaggtctagatacggaacgtaggtntagtaattacgttaacgacgtacgtaaggtactaataactaacgtaactacgaacgtaactaaacttacgttacgttacggttaccgggtaacgggtaacgtaacgggttaaactaacgttaccgtaacccggtaaccgttaccggttacggaacccgaaacccggtaaccccgtaaacccggtaacccctaacccgttacgttaaccgttaacccttaacccg

SEQ ID NO: 331780 - DNA, 643 bp, Homo sapiens
  misc_feature: GZ8MTXP01CNCKM.21.81.H04.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgacgttggtctttangactatgtctcctggtaccaacaanaccaggacaaacgccccaaactcatctatttangatgtcagtaatccggccctagtaggggtttctaatcgtttctcgtgcctaccagtcgtcgcaaacaccggcctccctgacctatctcgtcgggcctcgagctgatcggacgaggtctaggtactttacgtacgtcgtacgtacggtactattaaactaacaacttacgaacgacctaaacgttaccttaacgttcggttaccggttaccggggacgttaacggggaaacccttaaggtaccttaccgtaacccggtaccgttaacgggttacccaccggtaaccccgaaaccgggaacccctaaccccgtacgttaccgtaaccgttaacctttccccg

SEQ ID NO: 331781 - DNA, 571 bp, Homo sapiens
  misc_feature: GZ8MTXP01AYKHG.21.81.H04.1.454.CMB.2.raw
  modified_base (268)..(268): a, c, t, g, unknown or other
  misc_feature (268)..(268): n is a, c, g, or t
  modified_base (364)..(364): a, c, t, g, unknown or other
  misc_feature (364)..(364): n is a, c, g, or t
  modified_base (382)..(382): a, c, t, g, unknown or other
  misc_feature (382)..(382): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttatgactatgtctcctggtaccaacaanacccaggcaaacgcccccaaactcatcatttatgatgtcagtaatcggccctcgaggggtttctaatcgtcttctctcggctcaagtctggcaacncggcctccctgaccatcncgtgggctccgaggctagatgacgaggtctagattattactgcgagggtcaataatacaaatcaagacaaactacttatcgttccgttcggggaacgttgggaacccgaattccgttaccgaaccccgttccgacggttccaaccgaccccgaacggaccccaaccccgttacgtccgttctaaccccg

SEQ ID NO: 331782 - DNA, 589 bp, Homo sapiens
  misc_feature: GZ8MTXP01BB7HD.21.81.H04.1.454.CMB.2.raw
  modified_base (244)..(244): a, c, t, g, unknown or other
  misc_feature (244)..(244): n is a, c, g, or t
  modified_base (428)..(428): a, c, t, g, unknown or other
  misc_feature (428)..(428): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggacaaacgccccaaactcatcatttatcgatgtacagtaatcggcctcgtagggtttctaatcgcttctctcggctcaagtctggaacctaacgccggtcctccctgaccatcgtctgggtctcgaggctgatgacgagctgtattacttacngacaggggtctaatataacaagtcaacgactaaacctactttaagtcgttcgttccggggtaacttacgggggaacctaaaggttactacccgtaccgttaccgttaggttaccgaaccgacccgaacggaccccaaccccgacttccgttcgtaaccccg

SEQ ID NO: 331783 - DNA, 851 bp, Homo sapiens
  misc_feature: GZ8MTXP01CJHUY.21.81.H04.1.454.CMB.2.raw
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggccagtctgccctgactcagcctgcctcgtgtctgggtctctggacagtcgatcaacatctctgcacgtggaaccaggcggtgacgttggtcttaatgacttatgtctcgtacggtaaccaaacgaactaccaaggacaaaacgacccccaaaatcaatcaatttatggatcgtactaaggtaaacgtccggtaccccttacgggttaacggggttttacttaaacgttcggtacctttccgtacgttccgggtaccttaaccgaaaaggttttccgtaggggtaaaaccctaaaaaacccggcccgggtccccgttttaacccctacgggaaacccctaacttccgttacgtcgggggttaacccctaccgtacggtacgtacgtaacggtaacggtaacggtaacggtacgttaacgttaacgttaacgttacgttacgtacgtaacggggtaaacgttaaacttaaacgtaaacgtaaactaacgtaaacgtaaaccgttaaaccgttaaacgtttaaccgttaacggttaccgggttaaccgggtaaaccgggtaaaccgggttaaaccggtaaacgttaaaccgttaacccgttaacccggttaacccggttaaccggttaacccggtaacccggtaaaccccggaaaccccggtaaaccccgtaaaccccgttaacccgttaaccgttaacccgtaacccg

SEQ ID NO: 331784 - DNA, 524 bp, Homo sapiens
  misc_feature: GZ8MTXP01B5L7L.21.81.H04.1.454.CMB.2.raw
  modified_base (366)..(366): a, c, t, g, unknown or other
  misc_feature (366)..(366): n is a, c, g, or t
  modified_base (421)..(421): a, c, t, g, unknown or other
  misc_feature (421)..(421): n is a, c, g, or t
  modified_base (473)..(473): a, c, t, g, unknown or other
  misc_feature (473)..(473): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaactcatcatttatgatgtcagtaactcggccctcgtaggggtttctaatcgtcttctctcggctcagtctggacacncggcctccctgaccatctctgggctcgaggctgatgacgaggctgtattattacngcaggggtcagtatacaatcagcaactcttatgtcgttgggaactggacagntcgaccgttcgttcgttcaacgtcccaacggcccacccgactcgttctccg

SEQ ID NO: 331785 - DNA, 748 bp, Homo sapiens
  misc_feature: GZ8MTXP01AEY5P.21.81.H04.1.454.CMB.2.raw
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatccaccatcctcctgcacgtggaaccnggcggtagtacgttggtctttangtactatcgtctccgtacgtaaccaacaacacccaggaccaaaccgacccccaaactcatactaatttatgattgactagtaacgtccggcccttaggttacggggttttactaattccgtctttcgtcgtcggtcctactaaggtctcggaaccaaccgcccgtccctacccgtacgacctacgtcctcggtcgggtcctaccgacggtcctaggtagtacgggaaccggtacgggtcctttagttaaactttacgttaacgtcggtaacccgtaagggggttacctaaaagttaaactaaaccctaaacgttacccgaaacgtaacccgtaaaacctttacgttttaacggttcccgggtttaaccgggttaccgggggtaaccgttacggggaaacctaacgggaccttacccggtaaccccgttacggttacgttcccgaaacccgaccccgaacggacccccctaaaccgcttaaccgttccttaaccccg

SEQ ID NO: 331786 - DNA, 575 bp, Homo sapiens
  misc_feature: GZ8MTXP01AW39Y.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttggtctttangactatgtctcctggtaccaacaatacccaggcaaacgccccaaactcatactatttatgatgtcagtaactcggcctcgtaggggtttctaatcgtcttctctcggctacaagtctcgaaccaacnccggccctccctcgaccatcctcgtcgggctccgaggctgatgacgngtctagtattatacgtgacgaggggttcaattaactaacaatcgatacaaactacttactgtacgtcgggaactacgggaactaacgacgtccgtaaccgttccgttacgttaccgaacgacccgaaccggacccaacccgttctcgttccgtaaccc

SEQ ID NO: 331787 - DNA, 590 bp, Homo sapiens
  misc_feature: GZ8MTXP01BWU7I.21.81.H04.1.454.CMB.2.raw
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
  modified_base (441)..(441): a, c, t, g, unknown or other
  misc_feature (441)..(441): n is a, c, g, or t
  modified_base (467)..(467): a, c, t, g, unknown or other
  misc_feature (467)..(467): n is a, c, g, or t
tcagtcgtcgctcgcacgaccggtgctcgatttagtagtgtagattcgcgggggggggtctcaggaggcagcgctctcgggatgtctccaccatggcctgggctctgctattcctcaccctcctcactcagggcacagggtcctgggcccagtctgccctgactcagcctgcctcgtgtctgggtctcctggacagtcgatcaccatcctcctgcactaggaaccagcggtgtacgttggtctttangtactatgtctctaggtaccaanactaccagacaaacgaccccaaatcatcatttangatgtacaagtactcggccctgtagggttctaatcgcttctctggctacgaagtctaaggaccaacgaccggccctacccgtcgacctctctcgtcgggctaccgaggctgatacggacgaggtctatattagtacngcgtaggtactaatacaacatccaanacctaaactacttagtcgttccggttaacgggtaacgttacgggaaaccaaggtacctaccgttacccgggttcttacggaacacccgaacccgaacggaccccaacccctcttcgtaacccc

SEQ ID NO: 331788 - DNA, 778 bp, Homo sapiens
  misc_feature: GZ8MTXP01D31HZ.21.81.H04.1.454.CMB.2.raw
  modified_base (226)..(226): a, c, t, g, unknown or other
  misc_feature (226)..(226): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtggaaccngcggtgtacgttggttctttatgtactattcgtctcctacggtaaccaaacaactaaccccaaggaaccaaaccgaccccccaaaactccaacttactatttatagtattagtactaagttaacgtccggtaccccgttacggttaacggggttttacttaaacgttccgtcctttccgtcgttccgggtaccttaccgtaaacgttccgtacggaaccctaaacccgtcccgggtcccttaccccgtacgaccctacgttccgtcgtcgggcccttaccgacggtctacggagttagggaaccggtacgggtccttaggtaactttaacgttacgtacgtaccgtaaggggttactaaagttaaactaacctaaacttaccaacgtaacctaaacttaactttaagttcggttaccggttacgggaaccgttaacggggaaacctaaacggaccgttacccgtaaccgttccggttacgacccgaacccggtaaccccgaaacccgggaaccccctaaccccgttaacgttccgttaacccgttaaccccg

SEQ ID NO: 331789 - DNA, 587 bp, Homo sapiens
  misc_feature: GZ8MTXP01BK3ZH.21.81.H04.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtcttangactatgtctcctggtaccaacaanacccaggacaaacgaccccaaactcatcatttatgatgtacagtaactccggtcctcgtagggtttctaagttcgcttctctcggctcgaagtctggaaccaacgcggccctcctgacctatctctgggcctcgaggtctgatgacgngtctgtattatacngacagggtacatactacaatcaagactaaactctttagtcgttaccgttcggggaacttacggggaacctaaaggttactacccgtaacccgttaccgttacgggttaccaaccggaaccccgaacggaccccaaaccgaccctaacttcgtaacccc

SEQ ID NO: 331790 - DNA, 591 bp, Homo sapiens
  misc_feature: GZ8MTXP01EL8TP.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (373)..(373): a, c, t, g, unknown or other
  misc_feature (373)..(373): n is a, c, g, or t
  modified_base (574)..(574): a, c, t, g, unknown or other
  misc_feature (574)..(574): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctgtaccaacaanaccaggacaaacgaccccaaactcatctatttatgatgtcaagtaatccggcctacgtaggggtttctaattcgtcttctctcggctacaagtctcggaaccaacncgtccctccctgaccatctcgtcgggctcgagctgatgacgaggtctagtattagtactgacaggggtctaattaactaactaatcgaacgtactaaactaccttaagttcggttaccgttacggggaacttacggggaaccaaagttctaccgtaacccgttcgttacggttaccaaccgacccgaaacggcccaacccnctaacgttcgtaacccg

SEQ ID NO: 331791 - DNA, 630 bp, Homo sapiens
  misc_feature: GZ8MTXP01EDOTF.21.81.H04.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgacgttggtctttangtactatgtctactagtaccaacaataaccaacggaccaaacaccccaaactactacttacattatgatagtactacgtactcggtccgttactaggttctactcgtctctcctcgtctctacgtactacgacaacctacgcctacctctacctactcgtctcgcgtcgacgtcgtgagtacgtacgtagtactagtagttattacgtagtacgtagtactaactaactaacaaactacaactactaactaacttacgttacggtacgttaacgggtaacgttaacggtaaccgttaaacgtaaccgtacgttaccggttaccgttacggtaaccgtaaccgaaccccgaacccgtacccgttaaccctaaccgttccgtaaccg

SEQ ID NO: 331792 - DNA, 638 bp, Homo sapiens
  misc_feature: GZ8MTXP01DZBQU.21.81.H04.1.454.CMB.2.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgtttggtcttttangactntgtctctagtacaacaacaccagacaaacgacccaaactcatactatttatagtatgtactaagtaacgtccggtccttacggtacgggtttactaacgttcgtcttctcgtcggtcctacgtaacgtctacggaacctaaccgccggtccctccgtacgacctacgtcgtcgtcgggtctaccgaggtctagagtaggaacgaggtactagtattacgttacgtcgtacgtagggtactaataactaacaactcgaacgtaactaaacttacttagtcgttacggtacggaacgtacgggaaactaacgttacgtacgtacccgttacgttacggttaccaaccggaacccgaaccgaccccaacccgttacttccgttcctaaccg

SEQ ID NO: 331793 - DNA, 669 bp, Homo sapiens
  misc_feature: GZ8MTXP01AOZXZ.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaactacccaggacaaacgacccccaaatcatctatttatgtatntacagtaactcggccctacgtaggggtttactaagtccgtcttctctcggcctacgaagtcgtcggaacctaaccgcccggtaccctcccgtacgaccctattccgtcgtcggggcccttccgaggtcctaggtagtcggaccgtaggtaccttaggtaatttacgtacgtcgtaccgtaggggtaactataaacttaacgaactccaagacctaaacttacgttaacgttcgttacgttcgggtaacttacgggggaacctaaagttaccgtaccgtaaccgttacccgttacggggttacccaacgaaccccgaacggaccccaaaccccttacgtaaccgttaaccgttaaccccg

SEQ ID NO: 331794 - DNA, 898 bp, Homo sapiens
  misc_feature: GZ8MTXP01CPLP7.21.81.H04.1.454.CMB.2.raw
  modified_base (238)..(238): a, c, t, g, unknown or other
  misc_feature (238)..(238): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcatgaacagcggtgacgttgtcttangtactatgtctcgtagtaccaacaacaccaggacaaacgaccccaaactcaatactatttatagtattcgtactaagttaactccggtaccccttacgttacgggggtttactaaacgttccgtctttcctcgtcggtccttaccgaagttccgtacggaaacccaaccgtaacccgggtcccttacccgtacggtaacccctacgtccgttaaccggtccggggtcccttaccgaacggggtccttaggaacgttacggggaacgggttaacgggtccgttaagggttaaactttaaaccgtttaacggttcggaaccgttaacggggggtttaaacccctaaagtttttaaaaccgaaaccgttaaaaccttacccggaaacgttaaaccccgttaaaaaccgttaacccctttttaaaggttccggggtttaacccgggtttttaacccgggggaaacccggttttaaacccgggggaaaccccggtttaaaaccgggttaaaccttaaacccccgggttaacccgggtttaaaccccggttttaaaccgggttaccccgggtaaacccccggtaaaaccccggaaacccggggtttaaaccccccccgaaaacccctttaaccccgggttcgtttaaacccctttaaccccccggg

SEQ ID NO: 331795 - DNA, 592 bp, Homo sapiens
  misc_feature: GZ8MTXP01DYEAC.21.81.H04.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (380)..(380): a, c, t, g, unknown or other
  misc_feature (380)..(380): n is a, c, g, or t
  modified_base (475)..(475): a, c, t, g, unknown or other
  misc_feature (475)..(475): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccngcggtgtacgttggtctttangactatgtctcctggtaccaaacaactacccaggacaaacgacccccaaactccaatactatttaatgatgtacaagtaactcggaccttcgtagggtttctatcgtctctctcggcctacagtctggaaccaacncggcctccctcgacctatctcgtcgggcctcaggtctgatgacgaggtctagtattattactagccgtaggggtctaattaataacctaatcaanactaaactcttaattcgtcgttacgggaacgttacggggaacaaacgttactaccgtcgttaccgttaggttaccaacgacccgaaccggaccctaacccgactcgttcctaacccg

SEQ ID NO: 331796 - DNA, 720 bp, Homo sapiens
  misc_feature: GZ8MTXP01CIOP3.21.81.H04.1.454.CMB.2.raw
  modified_base (402)..(402): a, c, t, g, unknown or other
  misc_feature (402)..(402): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctggtctccgtggacagtcgatcaccatctctgcactggaaccaggtcggtgtacgttggttactttatgtacttatcgtctccgtacggtaaccaaacaaactaacccgacggaaccaaacgacccccaaactcactactatttatgtaatgtactaagtaacgtccggtcccgtagtagggtttactatcgtcttctctcgtctcgaagtctggaacaacncggtcctccctagacctatctcgtcggctcgagtctagagtagacgtaggtcttagtacttattaacgtgacgtaacggggtactaaacttaataaacctaattaccaacggtaacctaaaccttaagtttaaccgttcggttcccgggtttaaccgggggtaacccggttaacggggaaacccgtaaacgttaaccgtttaaccccggtaacccggttaccccggttaacgggaccccgttaaacccggaacccccggtaaaacccgaccccccggtaaaccccttaccgttaaccgttaaccccggttaacccccg

SEQ ID NO: 331797 - DNA, 602 bp, Homo sapiens
  misc_feature: GZ8MTXP01AK7D7.21.81.H04.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (412)..(412): a, c, t, g, unknown or other
  misc_feature (412)..(412): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtggaaccngcggtgtacgttgtctttangactatgtctctgtaccaacaanaccaggcaaacgccccaaactcatcatttangatgtacagtaactccggccctgtaggggttttcaattcgtcttctcgtcgctacaagtctggaccaacncgccctccctgacctatcgtcgtcgggcctacgaggtctgagngacgaggtctagtaattacttacgtgaccgtaggggtactaagttactaacgtaataccgaagtacctaaactacgtttatacgtcgtttacgggaacgtacgggaactaagttacgtaccgtaacccgttcgttaaggttcccgaacgtcccgaaacggccccaacccttactcgttaaccttaacccg

SEQ ID NO: 331798 - DNA, 821 bp, Homo sapiens
  misc_feature: GZ8MTXP01BPWOE.21.81.H04.1.454.CMB.2.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatccaccatctcctgcacgtggaaccngcggtgacgttggtctttangactatcgtctccgtaggtaaccaactaaactaaccccgaaggacccaaaaccgacccccctaaaaactcctaaacttaccttaattttaagtacgtaagtttacggttaaccgtaaacggttaaaccgtcccggggtacccccgtttagggtttaaacgggggtttttacctaaacggttcccgtcttttccgtacgttccgggtacctaccgtaaaaggtttcccgtacgggaaaccctaaaacccgcccgggtccccttaacccggtacgaaacccctacgtccttcgggacgggtcccttacccgaaggtccgtagttaacgtacgggaaaccgggtagttaccggttaagttaaccttaagtttaaccggtacggtaacgttaacggtaaactaaacgtaaccgtaaacaactacgaaactaaccgttaaacttacgtttacggttaccggttaccggtaacgggaacgttaacggaaacctaacgttaccgtacccgtaccgttacgttacggacccgaacccgaacccgtaaccgacccctaccgttacgtccgttaaccgtaaccg

SEQ ID NO: 331799 - DNA, 684 bp, Homo sapiens
  misc_feature: GZ8MTXP01AZCNT.21.81.H04.1.454.CMB.2.raw
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttggtcttatgactatgtctctggtacaacanaccaggacaaacgccccaaatcatctatttangatgtactagtaactccggtccctacgtagggggtttactaacttcgtcttcctcgtccggcctacgaagttctacggaacccaaccgtccggtccctcccgtacgaccctagtcctcggtcgggtcctcgaggtcgtagacgtagacggtacggtactaggttattacttacgtacgtacgtaacggggttactaagtttaactaaccgtaaattccaaagtaccctaaacttacgtttaacgttcggttacccgttacggggtaacgtaacggggaaacctaacggttacttacccggtaaccgttccggttacggttacccgtaaccggaccccgtaaaccgggaccccctaaccccgttacgtcccggttaacctttaaccccg

SEQ ID NO: 331800 - DNA, 604 bp, Homo sapiens
  misc_feature: GZ8MTXP01CPEJN.21.81.H04.1.454.CMB.2.raw
  modified_base (241)..(241): a, c, t, g, unknown or other
  misc_feature (241)..(241): n is a, c, g, or t
  modified_base (376)..(376): a, c, t, g, unknown or other
  misc_feature (376)..(376): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctctgcactggaaccaggcggtgacgttggtcttangacttatgtctcctggtaaccaacaatacccaggacaaacgacccccaaatcatctatttatgatgtacaagtaatccggccttagtaggggtttctaatccgtcttctcgtcgcctacaagtcgtgaaccaacnccggcctccctagaccatctcgtcgggctcgaggtctagataggacgtagtctacgtaattacgttaactgtacgaaggggttactaataactaacaaatcgaacgtactaaactacctttaagtcggttaccgttcggggaactacgggaacctaagcgtaccgtaccgttacgttacggttaccaacgtacccgaacggaccccaccttacgtccgttcctaaccc

SEQ ID NO: 331801 - DNA, 611 bp, Homo sapiens
  misc_feature: GZ8MTXP01AQTWI.21.81.H04.1.454.CMB.2.raw
  modified_base (244)..(244): a, c, t, g, unknown or other
  misc_feature (244)..(244): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggtctttangtactatgtctcctggtaccaaacaactacccaggaccaaacgacccccaaactcaatctaatttatgatgtacaagttaacgtccggaccccttgtaacgggggttttctaagttccgtcttctcgtcggacctacgaagtctcggaaccaaccgccggccctccctacgaccctagtctcgtcgggctccgaggtctgagtggaacgaggtctagtaattacttcngactagggtctaattanaactaatcgaatactaaacttacttacgtcgttccgtagggaactacgggactaagcgtaccgaccgttcgacggttacaaccgtaccccaacggccccaacccgttactcgttcgtaaccc

SEQ ID NO: 331802 - DNA, 657 bp, Homo sapiens
  misc_feature: GZ8MTXP01A1WXT.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggtcttatgtactatcgtctccgtaggtaaccaaacaactaccccgaggaccaaaccgacccccaaactcactactaatttatgtatgtactagtaactccggtcctgtagggtttactaactcgtcttctctcggtcctacgtaagtctacggaacccaaccgcccggtccctacccgtacgtaccctagttccgtcgtccggggtaccttacccgaacggggtcctaggtacgtacgggtaaacgggtacgggttacttaaggtttaactttacgttaacgtgtaccgtaggggtacttaagtaacaactaactcgaacaactaaactcttagtcgtaccgtggaacgtaggacctaaagcgtaccgtaccgttcgagttaccaaccgaccaaccgacctacccgctcgttccgtaacc

SEQ ID NO: 331803 - DNA, 705 bp, Homo sapiens
  misc_feature: GZ8MTXP01D54A1.21.81.H04.1.454.CMB.2.raw
  modified_base (310)..(310): a, c, t, g, unknown or other
  misc_feature (310)..(310): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggtcttatgactatgtctcctaggtaaccaacaactacccaggaccaaacgaccccctaaatcaatctatttangtatgtactaagtaacgtccggtccctgttaaggggtttctaacgttcgtcttctcgtccggcctacgtaagtcgtacgaaccaaccgtccggtccctcccgtacgaccctattccgtcggtcggtacctcgaggtctagactaggaacggtagtcgttagtacttaacgttacgtacgtactacgggggttactaaagttaaccttaaacgaaacttaccaacgtaacctaaacgttacgtttaacggttaccggttaccggttaccggggaacttacggggaaacctaaacgttaccgtaacccgtacccggttaccggttacggttacccgtaacccgtaccccgtaaccgtacccccaaccccgttacgttaacccgttccgttaaccccg

SEQ ID NO: 331804 - DNA, 577 bp, Homo sapiens
  misc_feature: GZ8MTXP01BU9UB.21.81.H04.1.454.CMB.2.raw
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
  modified_base (433)..(433): a, c, t, g, unknown or other
  misc_feature (433)..(433): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctgtacaacaanaccagacaaacgaccccaaatcatctatttactgatgtacagtaactcggaccctcgtaggggtttctaaacgtcgtacttcnctcggctacaagtctggaacaacncggcctcctgacctatctcgtcgggccttcgaggctggatagacgaggtctgattattcngcaggtacatataacatcgagacaaactcttaatgttaccgttcgggaacttagggaacctaaacggacttaccgaccggttacttacggggcccaaacgaccccgaaacggaccccaaacccgttacttcgttccgtaacccg

SEQ ID NO: 331805 - DNA, 649 bp, Homo sapiens
  misc_feature: GZ8MTXP01BH12I.21.81.H04.1.454.CMB.2.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgtacgttggtcttatgactatntctctggtacaacaanaccaggacaaacgaccccaaatcatacatttanagtatgtctaagtaacgtcggtaccctcgttaggggtttactatcgtcttctctcggctacaagtctaggaccaacgccgtccctcccgtgaccctatcgtcgtcgggtcctcgacggtctggtatcggaacggcgtacttggttaactttacgttacgtcggtacgtacgggggttactaaactaactaactaaacttacggacgtaactaaacctaccgtttatacgggttcgttacggggaacttacggggaactaacgttaacgtccggtaacccgttacgttacggacccgaaccggaccccaacgggcccctaaccgttacggtaaccgttaacttaacccg

SEQ ID NO: 331806 - DNA, 650 bp, Homo sapiens
  misc_feature: GZ8MTXP01D9A4G.21.81.H04.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (300)..(301): a, c, t, g, unknown or other
  misc_feature (300)..(301): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccngcggtgtacgttggtctttangactatgtctctgtaccaaacaacaccaggacaaacgaccccaaatcatctattannatgtacaagtaactcggcctacgtagggtttctaatcgtcttctcgtcgctacgagtctacggaacaacctccggccctacccgcgaacctactctcgtcgggtcctcgaggtctgagtcggaacggtacggtcttagtaattaacttacgacgtacgtaggggttactaaacttaaacttaaaccgaattaccgaaatacctaaaaccttatttaacgttcggttcggttacgggtaacgttacgggaaacctaaagttacgtacccgtaccggttaccgttacgggacccgaaccgaccccgaaaccggtacccccaaccccgttacgttccgttccgttaaccccg

SEQ ID NO: 331807 - DNA, 573 bp, Homo sapiens
  misc_feature: GZ8MTXP01EXS89.21.81.H04.1.454.CMB.2.raw
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (469)..(469): a, c, t, g, unknown or other
  misc_feature (469)..(469): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaanacccaggacaaagccccaaactcatcatttatgatgtacagtaaactcggtccctcgaggggtttctaagtcgtcttctcgtcggctcaagtctggacaacgaaccggccctccctacgacctactctcgtgggcctccgaggctgatggacgaggtctgattacttactgtcaggggttctaatatactaaatcgaacncaaactattatacgtcttcggggaacttgggaacctagaactcaaccgttccgttagttaccaagacccaacggacccaaccccttacgtcgttaactaacccg

SEQ ID NO: 331808 - DNA, 640 bp, Homo sapiens
  misc_feature: GZ8MTXP01DLVX0.21.81.H04.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcactgaaccngcggtgacgttggtctttangactatcgtctcctagtaccaacaanaccaggacaaacgccccaaatcatctatttangatgtactagtaatccggtcccttagtagggtttactaagtcgtacttctcgtcgcctacaagtctcgggaaaccaaccgtccggtaccctcccgtacgaccctacttccgtcgtcggggtccctacgacgggtactaggaacttacggaacggaggtccttagttaacttactaacgttgaccgtaggggtctaaagttaacttaaccaaagtacgaactaacaacttacgtttaatcggtcgttaacggggaactacgggaaccctaagaccgtacgtaccgttacgttcgttaccgaaccgtacccgaaccgacccaacccttctcgttaacctcccg

SEQ ID NO: 331809 - DNA, 710 bp, Homo sapiens
  misc_feature: GZ8MTXP01AGQI1.21.81.H04.1.454.CMB.2.raw
  modified_base (317)..(317): a, c, t, g, unknown or other
  misc_feature (317)..(317): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtaggaaccaggcggtgtacgttgtctttatgacttatcgtctccgtcgtaaccaacaacacccaggaccaaaccgacccccaaatccatctaagtttangtatgtactagtaactccggtccttcgtaggggttttacctaagttccgtcttcgtacgtcggtacctacgtaagtcctacggaacccaaacgcccggcccttaccctacgaccctacttccgtacgtcgggtccctacgtacggtctagtacgtaggacggaggttctaaggttacttacttcgtacgtacgtacggggttactaacttaactaacgtaacttacgaacgacctaaacttaacgttaacgttcggttaccgttccggggttaaccgacgggttaacctaaacggttaccgttacccggtaaccccgttcgttaaccggttaccgaacccgaccccgaaccgaaccccgtaaccccgttacgtcccgttaaccctaaccccgg

SEQ ID NO: 331810 - DNA, 622 bp, Homo sapiens
  misc_feature: GZ8MTXP01ALSI7.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaactacccaggcaaacgccccaaactcatctatttatgatgtacagtaactcggtccctcgtaggggtttctaatcgtcttctcgtgctcaagtctggacacnccggcctccngaccatctcgtcggctcgngctgatgacgngntgattatacgtgacgtaggggtacaagttaactaacgtaactcgaacgtacctaaacttctttagtcggttaccgtttcggggaaccgttacgggaaacctaaacgggaccttacccggtaacccgtttaccggttacggttacccgtaacggaacccccgaacgggtaacccccaaaaccccgttcgttaaccgttcccgtttaaccccg

SEQ ID NO: 331811 - DNA, 623 bp, Homo sapiens
  misc_feature: GZ8MTXP01BKA8O.21.81.H04.1.454.CMB.2.raw
  modified_base (319)..(319): a, c, t, g, unknown or other
  misc_feature (319)..(319): n is a, c, g, or t
  modified_base (467)..(467): a, c, t, g, unknown or other
  misc_feature (467)..(467): n is a, c, g, or t
  modified_base (500)..(500): a, c, t, g, unknown or other
  misc_feature (500)..(500): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggttctttatgacttatgtctccgtaggtaaccaaacaaacacccaggaccaaaaccgaccccctaaaactcatactatttangatgtacagtaactcgcctagtagggtttacagtcgtcttctcgtcgctacgagtctcggaacccaaacgtcccgcctacccgtgaccctagttcctcgtacgggtcctcgacggtctgacgtgaacgtagtctagtattcgttaacngactaggactataatacaatcaagactaaactnttagtcgttaccgtacgggtaacgtacgggaaacccagttaccgtacccgtacgttacccgttacgaccgaaccgaaccccgtaacggaccccaaacccgttcgtaaccttccgttaaccccg

SEQ ID NO: 331812 - DNA, 704 bp, Homo sapiens
  misc_feature: GZ8MTXP01A9CMG.21.81.H04.1.454.CMB.2.raw
  modified_base (335)..(335): a, c, t, g, unknown or other
  misc_feature (335)..(335): n is a, c, g, or t
  modified_base (694)..(694): a, c, t, g, unknown or other
  misc_feature (694)..(694): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacagtcgatcaccatctcctgcacgtcgaaccagtcggtgtacggttggttacttagtgtacttatcgttcctccgtacggtaaccctaaactaactaccccgaaggacccaaaccgaccccccaaatctactactatttangtatgtacacgtaacgtcccggtcctaggttacggtttactagttccgtcttcgtcgtccgacgtacgtagtcgacggaaccaaccgcccggtcctacccgtcgaccctacgttcgtccgttacgggcccgttaccgaggtctacggtaagttcggaaaccggtacggttacttaacgttaacgtttaacttaccggtagtaacccgtaaggggttacctaaattaaccttaaacaacgtaccaacgtactaaaccttcttaggtaccgtttcgggacggtaacgaacggactaaacgttcgtaccgtaccgttacgcgttaccgaaccacccggaaccctacccgaaccttcggtccnccgttaaccc

SEQ ID NO: 331813 - DNA, 660 bp, Homo sapiens
  misc_feature: GZ8MTXP01EIOF4.21.81.H04.1.454.CMB.2.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccngcggtgacgtttggtctttangtactntcgtctctgtaccaacaacaccagacaaacgacccaactcatactatttatgtatgtactaagttaacgtccggtcctacggttagggtttactaacgttccgtctttcgtcgtcggtacctactaacgtcgtacggaacccaaccgcccgtccctcccgtacgaccctactccgttcgtcgggcctaccgaggtctagtacgtcggaacggtaggtacttagtaatttacgttaacgttcgacgtacggggttactaaagttaactaaactaactacgaacgtaactaaaccttactttaagttcgttaccgttacgggtaacgttacgggaaacctaacggttactacgtacccgttcgttacggttaccaacgacccgaacgaccccacccgactccgttctaaccg

SEQ ID NO: 331814 - DNA, 561 bp, Homo sapiens
  misc_feature: GZ8MTXP01DEDK4.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
tcagtcgtcgctcgcacgaccggtgctcgatttagtagtgtagattcgcggggggggtctcaggaggcagcgctctcgggacgtctccaccatggcctgggctctgctattcctcacctcctcactcagggcacagggtcctgggcccagtctgccctgactcagcctgcctccgtgtctgggtctcctggacagtcgatcaccatctctgcactggaaccngcggtgacgttggtctttangtactatgtctcctggtaccaacaataccaggacaaacgccccaaactcatcatttatgatgtacaagtaactcggccctacgtaggggtttctaatcgtacttctctcggctacaagtctcggaacaacncggcctccctagacatctacgtcgggcctcgaggctgagtagaggngctgtattatactnacgaggtacataacacaatcacgacaaactacttaagtcgtcttacgggaactaggggaaactaagactctaccgttacgttgggttaccaacgacccaaggaccccaccgactcgttaactaacccg

SEQ ID NO: 331815 - DNA, 701 bp, Homo sapiens
  misc_feature: GZ8MTXP01A1B1A.21.81.H04.1.454.CMB.2.raw
  modified_base (243)..(243): a, c, t, g, unknown or other
  misc_feature (243)..(243): n is a, c, g, or t
  modified_base (319)..(319): a, c, t, g, unknown or other
  misc_feature (319)..(319): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaaccagcggtgtacgttggtctttangactatgtctcgtgtaccaacaacaccaggacaaacgaccccaaatcatactatttaatgtatgtacaagttaacnccggtccctaggtacgggtttactaagttccgtcttcgtcgtccggtacctacgtaaagtccgtacggaaccctaaaccgcccggtccctacccgttacgaacccttactaccccgtcggtccgggtacccttaccggaacggttccgtaggtacgttacgggaacccggtagggtccttaagttaactttacgtaaccgtggtaccgtaggggttaactaagtaactaaacacttaacgacgtaacctaaattacttagtcgttacgttacgggtaaacgtacggggaactaaacgttacgtacccgtaacgttaccgttcggacccgtaacgaaccccggaaccgtaaccccacccgttaacgttccgaaccgttaaccc

SEQ ID NO: 331816 - DNA, 671 bp, Homo sapiens
  misc_feature: GZ8MTXP01C8HPI.21.81.H04.1.454.CMB.2.raw
  modified_base (252)..(252): a, c, t, g, unknown or other
  misc_feature (252)..(252): n is a, c, g, or t
  modified_base (306)..(306): a, c, t, g, unknown or other
  misc_feature (306)..(306): n is a, c, g, or t
tcagtcgtcgctcgcacgaccggtgctcgatttagtagtgtagattcgcggggggggtctcaggaggcagtgctctcgggacgtctccaccatggcctgggctctgctattcctcaccctcctcactcagggcacagggtcctgggcccagtctgccctgactcagcctgcctccgtgtctgggtctctggacagtcgatcaccatcctctgcaacgtcggaaccaggtcggtgtacggttggttactttangtactatcgtctcgtacgaacaacaacaccaagacaaacgaccccaaatcactntagtttaatgatcgtacgtaacgtaacgtccggtaccgttacggttaacgggtttactagtccgttacttcgtcgtccgcctacgtagtccaggaaaccacgccgtccctccgtacgaccactccgtcgcgggtcctaccgaggtctagacgtacggaaacggtcgtacgttagtaatttaacgtacgttacgaccgttaaaggggtctaaacgttaaactaaacctaattaacccgaatacctaaaacttagttaacgtcggttcgttaacgggaacgtacggaaacagttcctaacgtcccgttagacgttaccgaaccgaacccgaacccgacctaaccccgagttaaccgccgttaacccg

SEQ ID NO: 331817 - DNA, 740 bp, Homo sapiens
  misc_feature: GZ8MTXP01ENUIV.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccagcggtgtacgttggtctttatgtactatcgtctccgtgtaaccaacaactaccaggacaaacgaccccaaatcatctattatgatgtacagtaacgtccgtacctacggtaggtttcagtcgtcttctcgtcgacctcaagtcgtacggaaccaacgccgtccctacccgtacgaccctacttcgcgtcggggtccctacggtaggccttagaacgttacggaaacgggtcgttacgttcgttaaacgtttagttacgttaacgggacctaaacgggggtttaactaacgtttaaacttaaaccgaaaacgtttaccccaaggtaacccttaaaaacccggtttattttaaaccggttcggtttacccgggttaacggggtaaaccggtttacgggggaaacccttaaaggttaccttaccccgggtaacccggttaccgttacggttaccgaacccgtaaacccggtaacccggacccctaaaccccggttcgttaaccgttaaccgtaacccg

SEQ ID NO: 331818 - DNA, 761 bp, Homo sapiens
  misc_feature: GZ8MTXP01ALAWS.21.81.H04.1.454.CMB.2.raw
  modified_base (593)..(593): a, c, t, g, unknown or other
  misc_feature (593)..(593): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatctcctgcacgtcggaaccaggcggttagtacggtttggttcctttagtcgtactattcgtccttaccgtacggtaaaccaaactaaaccgtaaccccgaacggaacccaaaacccgacccccctaaaactcctaaacttaccttaattttagtgtacttacggtaccgtaagttaaaccgtcccgggttaccccgtttacgggttaacgggggttttactaacgttccgttcttccgtcgtccggtaccttccgtaagttcgacggtaaaccctaacccggtaaccccggtccctcccgttacgaccccgtacttcccgtacgggtcccgggtccctacggagggtctaggacgttagggacggtaggtctatacgttaatcgngtacgagtactaataacaactactctaaacgacctaactcgttacgtcggtaccgtcgggaataacgggttaacaacgttccgtaccgtaaccgttccgttcggttaccgaacccgacccgtaaacccgggtaccctaaaccccgttacgttcgttcccttaaccccg

SEQ ID NO: 331819 - DNA, 714 bp, Homo sapiens
  misc_feature: GZ8MTXP01BRTR5.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatccaccatcctcctgcactggaaccaggtcggtgtacgttggttactttatgtacttatcgtctccgtacggtaaccaacaacacccagaccaaaccgaccccaactcactacttatttatgtattcgtactaagtaacgtccggtacccgttacggttacgggtttacttaacgtccgttcttcgtcgtccgctacgaacgtcgtacgaacccaaccgccggtccctcccgtcgacctacgttcgtcgtcggtacctccggaggtcgtgtacgtacggaacggacgggtcttacggttaacttacgtttaccgtcgaaccgttacgggttaacttaagttaaacctaacgtaacttaaccgaacgtaacctaaaccgtttacttacgttaccggttaccggttacggggtaacgtaacggaaaccgtaacggacctaccgtacccgttacgttacggttaccgaaccgtccccgaaaccggacccctaaaccgcgttaaccgttctaaccccg

SEQ ID NO: 331820 - DNA, 608 bp, Homo sapiens
  misc_feature: GZ8MTXP01DZX4R.21.81.H04.1.454.CMB.2.raw
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (375)..(375): a, c, t, g, unknown or other
  misc_feature (375)..(375): n is a, c, g, or t
  modified_base (500)..(500): a, c, t, g, unknown or other
  misc_feature (500)..(500): n is a, c, g, or t
  modified_base (594)..(594): a, c, t, g, unknown or other
  misc_feature (594)..(594): n is a, c, g, or t
tcagtcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccagcggtgacgttggtctttangactatgtctctgtacaacaanaccagacaaacgaccccaaatcatcatttangatgtacaagtaatccggacctagtacgggtttactaattcgtacttctctcggcctacgaagttctaggaaccaaacnccgggccctaccctacgacctatccgtcgtcgggtcctacgacggtacttagaacgttggaacggtaggtcctagtaacttaagtactagaccgtaagggtactaataaactacgaaatacgaanacctaaatacgttaatcgttcgttcgggaacgtacgggaacaaggactaccgtaaccgttcgttagccaacgacccgaacggacccctaaaccncgtcttccgtaacc

SEQ ID NO: 331821 - DNA, 712 bp, Homo sapiens
  misc_feature: GZ8MTXP01AGTGV.21.81.H04.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatccaccatctcctgcacgtggaaccngtcggtgacgttgtcttangactntgtctctggtaccacaataccaggacaaacgccccaaactcatactatttatgtatgtacagtaacgtccggtacctacgttagggggtttactaacgttccgtacttcgttcgtccggtcctacgtaaacgtccgtacggaaccctaaaccgtccggtcccctacccgtacgtacccctatcccgtcggtccgggtccctaccgagggtcctacggtaactacggaacgtacgggtaccttaaggtaactttacgttacgtcgtacgtacggggtactaagttaactaaacgtacgttaccaagtaccctaaactaccgttagttacgttccggtacgggtaacgttaacggaaacctaacgttacgtacccgtccggttaccgttggttacccaacccgggacccctaaaccggaaccccctaaccccgttacttaaccggttaacccttaacccccgg

SEQ ID NO: 331822 - DNA, 777 bp, Homo sapiens
  misc_feature: GZ8MTXP01B7ASO.21.81.H04.1.454.CMB.2.raw
  modified_base (245)..(245): a, c, t, g, unknown or other
  misc_feature (245)..(245): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttttangtactatgtctccgtggtaccaacaatacccaggaccaaacgacccccaaactcaatcatttatgatgtacagtaactcgggcctacgtaggggtttctaattcgtctttctcgtcggcctaccgtaaagtccgtagggaaccaaaccgtccgggtccccttacccgttacggaacccctaacgttcccttcgtaccgggggtccctttacccgaacgggggtccttagggaaacgtttcggggaaaccgggttaacggggtcctttaagggtaaacttttaacgtttaaaccgttcggtaacccggtaaggggggtttacctaaagtttaaacctaaacgttaaacctacaacggaaccctaaaacttaaccgtttaagttccggttaccggtttaccgggggaaccgttaacgggggaacccctaaaagggttacttaccccggaacggtttaccccgttaagggttacccgaacggacccccgtaaagggacccccaaaccccttaccgttcgttaaccccgtaacccg

SEQ ID NO: 331823 - DNA, 728 bp, Homo sapiens
  misc_feature: GZ8MTXP01AVX1G.21.81.H04.1.454.CMB.2.raw
  modified_base (271)..(271): a, c, t, g, unknown or other
  misc_feature (271)..(271): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctggacccagtctgccctgactcagcctgcctccgtgtctgggtctcctggacagtcgatccaccatctcctgcactggaaccaggcggtgacgttggtctttatgactatgtctcctggtaccaacaanacccaggacaaagacccccaaactcatcatttatgatgtcagtaatcggccctctaaggggtttctaagtcgtcttctctcgctcaagtctcggaacaacgccggtaccctcccctacgaccgacttcctcgttcggggccttccgaggtccgttaggacttacggaaccgggtaggtaccgtagttaatttaacgttaaacgtcgtacgtacgggggtactaaacgttaaacttaaccgtaaaactcctaaacgccgtaaaaccttaaccggttttaaacttcggtttaccgtttaaccggggtaaccggttacgggggaaacccgtaaacgggttaccttaaaccgtaaccccgggtttacccgttaaccgggttacccgaacccgggtaacccccgtaaacccgggacccccaaaacccccgttacccgttaaccggttccctttaacccccgg

SEQ ID NO: 331824 - DNA, 746 bp, Homo sapiens
  misc_feature: GZ8MTXP01AWH0Q.21.81.H04.1.454.CMB.2.raw
  modified_base (224)..(224): a, c, t, g, unknown or other
  misc_feature (224)..(224): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtggaaccnggtcggtgtacgttggtactttatgactatcgtctccgtacggtaaccaacaactaccgaggaccaaaccgacccccaaactcatactaatttatagtatgtactaagtaacgtccggtcccgtacgttaaggggtttctaagtccgtcttctcgtccgtcctacaagttcctaggaaccaacccgtccggtccctccccgtagaacccctcttccgtccgtacggggtccctaccggtaggtaccgttaggacgttacggtaaccggtaacgggtcctaagggttaaactttaaccgttaacggttcgaacccgttagggggtaaccctaaagtttaaacgtaaacccgtaaataccgtaaacgtaacccttaaaacgttactttagtaccgggttaccggttcggggtaaaccgtacggggaaacctaaacgttaccgtacccgtaacccggttacgttacgggacaaccggtaaccccgaacggtacccccaacccttaccttaacgttaacccgtccg

SEQ ID NO: 331825 - DNA, 643 bp, Homo sapiens
  misc_feature: GZ8MTXP01AQDJL.21.81.H04.1.454.CMB.2.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccntctctgcacgtggaaccnggtcggtgtacgttggtcttatgtacttatgtctccgtagaccaacacaccaggaccaaacgaccccaatctatctatttananatgtacagtactccgcctgtacggttnacgtctctctncgcctacgagtcgtcgaaccaacgccgccctctcgtacctacttcgtcgtacgggccttaccgaggtctaggaacgtcggaaacggcgttacgtagttaacgttacgttcgtagtaccgtaggggttactaaataacgtaacctaagtacaacgtactaacgtacttgttacgtcggtacggtaaccgtcgggttaaaccacggttcctaaaccgtccgttaaccggttcggaaacccgtccggaaccccgtaaccgtaccccggtaaaccccttacgttccgttccgtaaccccg

SEQ ID NO: 331826 - DNA, 765 bp, Homo sapiens
  misc_feature: GZ8MTXP01AH7RG.21.81.H04.1.454.CMB.2.raw
  modified_base (244)..(244): a, c, t, g, unknown or other
  misc_feature (244)..(244): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccaggcggtgtacgttgtctttangtactatgtctcctggtaccaacaatacccgaggacaaacgccccaaactcatacatttatagatcgtactagtaactaccggtccctacgtagggggtttactaaacgtccgtcttctctccggtcctacgtaacgtccgtacggaaccaaaccgcccggtccctaccccgttagaacccctatcccgtcgtccgggtacctaccggacggtcctagggtacttagggaaccgtacgggtaccttaggtaaacctttagttacccgtagtacccggttaacgggggtccctaaagttaccgttaaacttaaaccgtaaccaaacgtaacctaaaccttaccgtttaaacgtccgggtttacccgttaccgggggtaacgttaccgggaaacgtaaccgttaaacgttaccccggtaaccgttaacccggtttacgggttaaccccgaacccgggtaaccccggaaaacccgggaccccgtaaacccccttaacggtaaccttaaccccggttaacccccg

SEQ ID NO: 331827 - DNA, 766 bp, Homo sapiens
  misc_feature: GZ8MTXP01DVN58.21.81.H04.1.454.CMB.2.raw
  modified_base (229)..(229): a, c, t, g, unknown or other
  misc_feature (229)..(229): n is a, c, g, or t
  modified_base (331)..(331): a, c, t, g, unknown or other
  misc_feature (331)..(331): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtcgtcgggttctcctggacagtcgatccaccatctcctgcactcggaaccnggtcggtgtaacggttgggttactttagtgtactattcgtctcctaggtaacccaaacaactacccgagacctaaacgacccccaaataccatctaatttanagtactgtacgtaagtaacgtccggacccgttacggttaggggtttacctaacgttccgttactttctccggttcggtacccttacgtaaagtcccttcggaaaacccaaccgtaacccgggcccttaccccgtacggtaaccctacgtcccgttcgtccggggtccttaccgacggtctacgtacgtaggaacgggtcgtacgtagttaaattaccttagcgtagtacgggtaactattaactaaacgacttacgacaacgtaaaacgtttcttaacgtttacgtccgggttccgggtaaacgtaccgggaaaccttaaacgccgttaaacccggttaaccccggttaacggttaacccgggttccgttaaaccccgaaccccgaaccggtaaccccctaaaaccccttcgtaacgttaaccctttaacccccg

SEQ ID NO: 331828 - DNA, 620 bp, Homo sapiens
  misc_feature: GZ8MTXP01C5PEZ.21.81.H04.1.454.CMB.2.raw
  modified_base (389)..(389): a, c, t, g, unknown or other
  misc_feature (389)..(389): n is a, c, g, or t
  modified_base (453)..(453): a, c, t, g, unknown or other
  misc_feature (453)..(453): n is a, c, g, or t
  modified_base (607)..(607): a, c, t, g, unknown or other
  misc_feature (607)..(607): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccagcggtgtacgttggtcttatgtactatgtctctggtaacaaacaactacccaaggaccaaaccgaccccaaaactcaatactaatttatagtatgtactaagttaactccggtcccttaggtagggggtttactaattccgtcttcgcttacggctacgaagttcncggaacaactccggccctaccctgtaccatctcgtcgggcctaccgaggtctagactgaacggngtactagtaattacgtatagacgaggtactaaataagtaactaacacaacgtaactaacttacgttagtccgttacgggtacgggaacgtaacggaactaaacgttccgtaacgtccgttacgacgaccaaccgacccgtaacgacccctaacnctccgaacgtccg

SEQ ID NO: 331829 - DNA, 626 bp, Homo sapiens
  misc_feature: GZ8MTXP02GHD51.21.81.H04.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (363)..(363): a, c, t, g, unknown or other
  misc_feature (363)..(363): n is a, c, g, or t
  modified_base (413)..(413): a, c, t, g, unknown or other
  misc_feature (413)..(413): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtctttangactatgtctcctggtaccaacaatacccaggacaaacgccccaaactcatcatttatgatgtcagtaatcggcctgtagggtttctaatcgcttctctcggctccaagtctggaccaacnccggccctcctgacctatctcgtcgggcctcgaggtctagatggaacggnggtctagtaatttacttacgtagacgtaaggttactaattaactaaccaaattaccgaagtacctaaactaactttagtacggtttaccgttacggggtaacgtacggggaaaccctaaaggtacctaccgtaaccccggttaccgtaacggttaccgaaccggacccccgaaacgggacccccaaaccccgtacttccggtacttaaccccg

SEQ ID NO: 331830 - DNA, 498 bp, Homo sapiens
  misc_feature: GZ8MTXP02G6LWO.21.81.H04.1.454.CMB.2.raw
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggcctnaggggtttctaatcgcttctctgctcagtctggcaacncggcctcctgaccatctctggctccaggctgatgacgaggctgattattactgcaggtcatatacaatcagcaaacacttatgtcttcggactgggaccaagatcacgtcaggtcaagcccaaggccaacccactcgtctacc

SEQ ID NO: 331831 - DNA, 510 bp, Homo sapiens
  misc_feature: GZ8MTXP02F0QJB.21.81.H04.1.454.CMB.2.raw
  modified_base (359)..(359): a, c, t, g, unknown or other
  misc_feature (359)..(359): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggcctcaggggtttctaatcgcttctctcggctccaagtctggcaacncggcctcctgaccatctctgggctcaggctgatgacgaggctgattatactgcaggtcatatacaatcagacaacacttatgtcttcggactggggaccaagactcaccgtctaggtacaagcccaaaggcccaaccccactcgtactacc

SEQ ID NO: 331832 - DNA, 509 bp, Homo sapiens
  misc_feature: GZ8MTXP02HQJBR.21.81.H04.1.454.CMB.2.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaatcatcatttangatgtcagtaatcggccctgaggggtttctaatcgtcttctctcggctcaagtctggcaacncggcctcctgacccatctctgggctcaggctgatgacgaggctgattatactgcaggtcatatacaatcagcaacacttatgtcttcgggacttgggaccaagactcaccgtctaggtcaagcccaaggcccaacccactcgtactacc

SEQ ID NO: 331833 - DNA, 507 bp, Homo sapiens
  misc_feature: GZ8MTXP02JPQ5Z.21.81.H04.1.454.CMB.2.raw
  modified_base (241)..(241): a, c, t, g, unknown or other
  misc_feature (241)..(241): n is a, c, g, or t
  modified_base (360)..(360): a, c, t, g, unknown or other
  misc_feature (360)..(360): n is a, c, g, or t
  modified_base (438)..(438): a, c, t, g, unknown or other
  misc_feature (438)..(438): n is a, c, g, or t
tcagtcgtcgctcgcacgaccggtgctcgatttagtagtgtagattcgcgggggtctcaggaggcagcgctctcgggacgtctccaccattgcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctcaggggtttctaatcgcttctctcggctccaagtctggcaacncggcctcctgaccatctctgggctccaggctgatgacgaggctgattattactgcaggtcatatacaatcagcaaacncttatgtcttcgggactgggaccaagatcaccgtcctaggtcaagcccaaggccaacccactcgtctac

SEQ ID NO: 331834 - DNA, 522 bp, Homo sapiens
  misc_feature: GZ8MTXP02F3F3D.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (511)..(511): a, c, t, g, unknown or other
  misc_feature (511)..(511): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaataccccaggcaaacgcccccaaactcatcatttangatgtcagtaatcggccctgaggggtttctaatcgcttctctggctccaagtctggcaacncggcctcctgaccatcnctgggctcgaggctgatgacgaggctagattatactgcaggtcatatacaatcagcaaactacttatgtcttcgggactggggaccaaagactacgaccgtactaggtacaagcccaaacggcccaaacccnctacgtctacc

SEQ ID NO: 331835 - DNA, 532 bp, Homo sapiens
  misc_feature: GZ8MTXP02I45RA.21.81.H04.1.454.CMB.2.raw
  modified_base (221)..(221): a, c, t, g, unknown or other
  misc_feature (221)..(221): n is a, c, g, or t
  modified_base (283)..(283): a, c, t, g, unknown or other
  misc_feature (283)..(283): n is a, c, g, or t
  modified_base (392)..(392): a, c, t, g, unknown or other
  misc_feature (392)..(392): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttatgactatgtctctggtacaacaataccagcaaagccccaaacncatcatttatgatgtcagtaatcgcctcaggggtttctaaatcgcttctctcggctccaagtctggcaacacggcctccctgaccatctctgggctcagctgatgacgngctgattatactgcaggtcatatacaatcagacaactacttaatgttcgttacggacgttgggaacccaaaggtactacgacccgtacctaggtaccaacgacccaaacggacccaaaccccacgtacgttactaacccg

SEQ ID NO: 331836 - DNA, 542 bp, Homo sapiens
  misc_feature: GZ8MTXP02F11QB.21.81.H04.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
  modified_base (413)..(413): a, c, t, g, unknown or other
  misc_feature (413)..(413): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaagcccccaaactcatcatttangatgtcagtaatcggccctcgtaggggtttctaatcgcttctctgctccaagtctgcaacncgcctccctgaccatctctgggcctcgaggctgatgacgaggctgattattacngcaggtcatatacaatcaagacaaactacttaatcgttacgttacggggtactaggggtaaccaaaggtactcctaaccgtctacggtacaacgacccgaaacggcccaaacccgactcgtacctaccg

SEQ ID NO: 331837 - DNA, 510 bp, Homo sapiens
  misc_feature: GZ8MTXP02GN9CO.21.81.H04.1.454.CMB.2.raw
  modified_base (241)..(241): a, c, t, g, unknown or other
  misc_feature (241)..(241): n is a, c, g, or t
  modified_base (359)..(359): a, c, t, g, unknown or other
  misc_feature (359)..(359): n is a, c, g, or t
  modified_base (412)..(412): a, c, t, g, unknown or other
  misc_feature (412)..(412): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctcaggggtttctaatcgcttctctggctccaagtctggcaacncggcctccctgaccatctctgggctccaggctgatgacgaggctgattatacngcaggtcatatacaatcagcaaacacttatgtcttcgggactgggaccaagatcaccgtctaggtcaagacccaaggcccaacccgactcgtactacc

SEQ ID NO: 331838 - DNA, 530 bp, Homo sapiens
  misc_feature: GZ8MTXP02I7T7Q.21.81.H04.1.454.CMB.2.raw
  modified_base (298)..(298): a, c, t, g, unknown or other
  misc_feature (298)..(298): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttangatgtcagtaatcggccctcaggggtttctaaatcgcttctctggcctccaagtctggcaacncggcctccctgacccatctctgggctccaggctgatgacgaggctgattattactgcaggtcatatacaaatccagacaacaactttatcgtactttcgggaactggggaaccaaaggactcaccgtccgtaggtcaacgcccaaaggcccaaacccactcgtactacc

SEQ ID NO: 331839 - DNA, 502 bp, Homo sapiens
  misc_feature: GZ8MTXP02I0WFU.21.81.H04.1.454.CMB.2.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttatgactatgtctctggtaccaacaatacccagcaaagcccccaaatcatcatttangatgtcagtaatcggccctcaggggtttctaatcgcttctctggctccaagtctggacaacncggcctccctgacccatctctgggctccaggctgatgacgaggctgattatactgcaggtcatatacaatcagcaacacttatgtcttcgggactgggaaccagactcaccgtctaggcaagcccaaggcccaaccactcgtcac

SEQ ID NO: 331840 - DNA, 533 bp, Homo sapiens
  misc_feature: GZ8MTXP02GBGB4.21.81.H04.1.454.CMB.2.raw
  modified_base (241)..(241): a, c, t, g, unknown or other
  misc_feature (241)..(241): n is a, c, g, or t
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
  modified_base (520)..(520): a, c, t, g, unknown or other
  misc_feature (520)..(520): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctgtaccaacaatacccaggcaaagcccccaaatcatcatttangatgtcagtaatcggccctcgaggggtttctaatcgcttctctgctccaagtctggcaacncggcctccctgaccatctctcgggctcgaggctgatgacgaggctgtattatactgacaggtcatatacaatcagacaaactactttatgtctttacggggacttggggaaccaaggtactccgaaccgtctaaggtcaacgcccaaaacggcccaaaccccngtacgtacctacc

SEQ ID NO: 331841 - DNA, 502 bp, Homo sapiens
  misc_feature: GZ8MTXP02GDN1N.21.81.H04.1.454.CMB.2.raw
  modified_base (241)..(241): a, c, t, g, unknown or other
  misc_feature (241)..(241): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctcaggggtttctaaatcgcttctctgctccaaagtctggcaacncggcctccctgaccatctctgggctcaggctgatgacgagctgattatactgcaggtcatatacaatcagcaacacttatgtcttcggactgggaccaagatcacgtcctaggtcaagcccaaggccaacccactcgctacc

SEQ ID NO: 331842 - DNA, 564 bp, Homo sapiens
  misc_feature: GZ8MTXP02G8476.21.81.H04.1.454.CMB.2.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaacgccccaaactcatcatttangatgtcagtaatccggcctcgtaggggtttctaatcgcttctctcggctcagtctggacaacnccggcctcctcgaccagtctctgggcctcgaggctgatcgacgnggctagattatcngcagtcatatacaatcagacaactacttatcgtcgttacgggacttacggggaaaccaaggtactaccgtaacccgttaccgtaagggttaccaaccggacccgaaaccgggcccctaaaaccccaccgttcggtaccctaacccg

SEQ ID NO: 331843 - DNA, 510 bp, Homo sapiens
  misc_feature: GZ8MTXP02GVF3M.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaagcccccaaactcatcatttangatgtcagtaatcggccctcaggggtttctaatcgcttctctggctccaagtctggcaacncggcctcctgaccatctctgggctccaggctgatgacgaggctgattatactgcaggtcatatacaatcagcaaacacttatgtcttcgggactgggaccaagatcaccgtctaggtcaagcccaacggcccaaacccactcgtactacc

SEQ ID NO: 331844 - DNA, 580 bp, Homo sapiens
  misc_feature: GZ8MTXP02JX1WF.21.81.H04.1.454.CMB.2.raw
  modified_base (363)..(363): a, c, t, g, unknown or other
  misc_feature (363)..(363): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacatacccaggacaaacgcccccaaactcatcatttatgatgtcagtaactcggccctcgtaggggtttctaatcgtcttctctcgctcagtctggcacncgcctcctgaccatctcgtgggcctccgaggctgatgacgaggcttagtatttattacgtgtcgaggtctaattaactactaaatcaagactaaactactttatcgtacgttacgggtactacggggaaacctaaacggtactaccgacccgttaccgtaacggtccaaccggaccccgaaacggaccccaaaccccgtacgtaccgtacctaaccc

SEQ ID NO: 331845 - DNA, 555 bp, Homo sapiens
  misc_feature: GZ8MTXP02IUH00.21.81.H04.1.454.CMB.2.raw
  modified_base (222)..(222): a, c, t, g, unknown or other
  misc_feature (222)..(222): n is a, c, g, or t
  modified_base (355)..(355): a, c, t, g, unknown or other
  misc_feature (355)..(355): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttatgactatgtctcctggtaccaacaataccaggcaaagcccccaaactcatcatttatgatgtcagtaatcggcctcaggggtttctaatcgcttctctgctcagtctggcaacncggcctccctgaccatctcgtgggctccaggctgatgacgaggctgtaattatactgctaggtacattatacaaatcaagacaaactaactttatgtcgttacgggacgttggggaaccaaaggactaccgaccgttaccgttaaggtaccaacggaccccaaacgggaccccaaaccccgtacttcggtaccctaaccg

SEQ ID NO: 331846 - DNA, 509 bp, Homo sapiens
  misc_feature: GZ8MTXP02J1WKP.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (440)..(440): a, c, t, g, unknown or other
  misc_feature (440)..(440): n is a, c, g, or t
  modified_base (499)..(499): a, c, t, g, unknown or other
  misc_feature (499)..(499): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaatacccaggcaaagcccccaaactcatcatttatgatgtcagtaatcggccctnaggggtttcaatcgcttctctggctccaagtctggcaacncggcctcctgaccatctctgggctccaggctgatgacgagctgattatactgcaggtcatatacaatcagacaactacttangtcgttcggactgggaccaaagctacaccgtcctaggtcaacgcccaaggcccaacccnctcgtcctac

SEQ ID NO: 331847 - DNA, 514 bp, Homo sapiens
  misc_feature: GZ8MTXP02F20D5.21.81.H04.1.454.CMB.2.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
  modified_base (481)..(481): a, c, t, g, unknown or other
  misc_feature (481)..(481): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaagcccccaaactcatcatttangatgtcagtaatcggccctcaggggtttctaaatcgcttctctggctcaagtctggcaacncggcctccctgacccatctctcgggctccgaggctgatgacgaggctgattatactgcaggtcatatanaatcagcaaactacttatgtcttcgggactgggaccaagactcaccgtcnggtacaacgacccgaagcccaacccatcgtcac

SEQ ID NO: 331848 - DNA, 505 bp, Homo sapiens
  misc_feature: GZ8MTXP02FLQLZ.21.81.H04.1.454.CMB.2.raw
  modified_base (241)..(241): a, c, t, g, unknown or other
  misc_feature (241)..(241): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (444)..(444): a, c, t, g, unknown or other
  misc_feature (444)..(444): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctcaggggtttctaaatcgnttctctggctccaagtctggcaacncggcctccctgacccatctctgggctccaggctgatgacgaggctgattatactgcaggtcatatacaatcagcaaacacttangtcttcgggactgggaccaagatcaccgtcaggtcaagcccaaggccaacccactcgtcac

SEQ ID NO: 331849 - DNA, 521 bp, Homo sapiens
  misc_feature: GZ8MTXP02G1HRU.21.81.H04.1.454.CMB.2.raw
  modified_base (243)..(243): a, c, t, g, unknown or other
  misc_feature (243)..(243): n is a, c, g, or t
  modified_base (360)..(360): a, c, t, g, unknown or other
  misc_feature (360)..(360): n is a, c, g, or t
  modified_base (399)..(399): a, c, t, g, unknown or other
  misc_feature (399)..(399): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaagcccccaaactcatcatttatgatgtcagtaatcggcctcgaggggtttctaatcgcttctctggctccaagtctggcaacncggcctcctgaccatctctgggctccaggctgatgacgnggctgattatactgcaggtcatatacaatcagacaaactacttatcgtcgttacgggactgggaccaaaggctacaccgtcctaggtcaacgcccaaacggcccaacccactcgtactaccg

SEQ ID NO: 331850 - DNA, 575 bp, Homo sapiens
  misc_feature: GZ8MTXP02I9UMT.21.81.H04.1.454.CMB.2.raw
  modified_base (360)..(360): a, c, t, g, unknown or other
  misc_feature (360)..(360): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctctaggggtttctaatcgcttctctgctccagtctggcaacnccggcctccctgaccatctctcgggctccaggctgatgacgaggctgattatactgctaggtcatatacaatcagacaaactacttatcgttcgttacgggtacttcgggggaaaccctaaaggtaactacccgtacccggttacctaacggggttaccaaccggaccccaaaacgggaccccctaaaacccccgaccttcggtaccttaacccg

SEQ ID NO: 331851 - DNA, 526 bp, Homo sapiens
  misc_feature: GZ8MTXP02I61K4.21.81.H04.1.454.CMB.2.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaagcccccaaactcatcatttangatgtcagtaatcggccctcaggggtttctaatcgtcttctctggctccaagtctggcaacncggcctccctgacccatctctgggctccaggctgatgacgaggctgattattactgcaggtcatatacaaatcagacaactacttatgtcttacgggactgggaaccaagactcaccgtctacggtcaacgtcccaaacggcccaacccgactcgtactaacc

SEQ ID NO: 331852 - DNA, 522 bp, Homo sapiens
  misc_feature: GZ8MTXP02I3YBQ.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaataccaggcaaagcccccaaactcatcatttatgatgtcagtaatcggcctcaggggtttctaaatcgtcttctctcggctccaagtctggcaacncggcctccctgaccatctctgggctccgaggctgatgacgagctgattatactgctaggtcatataacaatcagacaaacacttatgttcgttacgggactacgggaccaagactcaccgtcgtagtcaacgtcccaacggtcccaacccgctcgactacc

SEQ ID NO: 331853 - DNA, 512 bp, Homo sapiens
  misc_feature: GZ8MTXP02JPGCZ.21.81.H04.1.454.CMB.2.raw
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctggtaccaacaatacccaggcaaagcccccaaactcatcatttatgatgtcagtaatcggccctcaggggtttctaatcgcttctctcggctccaagtctggcaacncggcctccctgaccatctctcgggctccaggctgatgacgnggctgattatactgcaggtcatatacaatcagacaacacttatgtcttcgggactagggacaagatacaccgtctaggtacaagacccaaggcccaacccactcgactacc

SEQ ID NO: 331854 - DNA, 514 bp, Homo sapiens
  misc_feature: GZ8MTXP02HAEEE.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (409)..(409): a, c, t, g, unknown or other
  misc_feature (409)..(409): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaataccatgacaaacgcccccaaatcatcatttatgatgtcagtaatcggccctcgagggtttctaatcgcttctcctgctcagtctggcacacggcctcctgaccatctctgggctccaggctgatgacgaggctagattatacngcaggtcatatacaatcagacaactacttatgtcttacgggactgggaaccaagactcgaccgtcctaaggtccacgacccgaacggcccaaacccgctcgtacc

SEQ ID NO: 331855 - DNA, 541 bp, Homo sapiens
  misc_feature: GZ8MTXP02JZNYM.21.81.H04.1.454.CMB.2.raw
  modified_base (243)..(243): a, c, t, g, unknown or other
  misc_feature (243)..(243): n is a, c, g, or t
  modified_base (321)..(321): a, c, t, g, unknown or other
  misc_feature (321)..(321): n is a, c, g, or t
  modified_base (359)..(359): a, c, t, g, unknown or other
  misc_feature (359)..(359): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangacttatgtctcctggtaccaacaatacccaggcaaagcccccaaactcatcatttatgatgtcagtaatcggccctnaggggtttcaatcgcttctctggctcagtctggcaacncggcctccctgaccatctctgggcctccaggctgatgacgaggctagatttacttactgctaggtcatatacaatcagacaactacttatgtcgttacgggacttcgggaaccaaggtactcgtaccgtaccgtaggtaccaacgaccccaacggacccaaacccccactacgtacctaccg

SEQ ID NO: 331856 - DNA, 637 bp, Homo sapiens
  misc_feature: GZ8MTXP02FZ6HN.21.81.H04.1.454.CMB.2.raw
  modified_base (242)..(242): a, c, t, g, unknown or other
  misc_feature (242)..(242): n is a, c, g, or t
  modified_base (301)..(301): a, c, t, g, unknown or other
  misc_feature (301)..(301): n is a, c, g, or t
  modified_base (491)..(491): a, c, t, g, unknown or other
  misc_feature (491)..(491): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggccaaacgcccccaaactcatcatttangatgtcagtaatccggccctgtaggggtttctaatcgcttctcgtcggcctaccaagtcctaggaccaaacgccggtcctccctaggaccccattcctcgtcgggacctcccgaaggtctagagttcgaacgaggcttagattagttactgacaggttcaatactaacaatccagactaaactaactttntacgttacgtttacggggaaccttagggggaaaccctaaaggtaaccttccgtaaaacccgggtttccctaacggggttaacccaaccgggacccccgaaaacggtacccccaaaacccccgtaacttcggtacccttaaccccgg

SEQ ID NO: 331857 - DNA, 515 bp, Homo sapiens
  misc_feature: GZ8MTXP02JTIXV.21.81.H04.1.454.CMB.2.raw
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaagcccccaaatcatcatttangatgtcagtaatcggccctgaggggtttctaatcgcttctctcggctccaagtctggcaacncggcctcctgaccatctctgggctccgagctgatgacgaggctgtattattactgctaggtcatatacaatcagcaaactctatgtctcgggactgggaccaagactcaccgtctaggtcaagaccccaacggcccaacccactcgtactacc

SEQ ID NO: 331858 - DNA, 546 bp, Homo sapiens
  misc_feature: GZ8MTXP02G68JJ.21.81.H04.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
tcagtcgtcgctcgcacgaccggtgctcgatttagtagtgtagattcgcgggggggtctcaggaggcagtgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtcttangactntgtctctggtacaacataccagcaaagccccaaatcatcatttatgatgtcagtaactcggccctcgtaggggtttctaatcgtcttctctcggctccaagtctggcaacacggcctcctcgaccatctcgtgggctccaggctgatgacgaggctagattatactgcgagtcatatacaatcagacaaactacttatcgtacgttcggggaacttcggggaaaccaaggtacttaccgaccgttaccgtaggtccaacgaccccgaacggaccccaaaaccccgctaccgtactacccg

SEQ ID NO: 331859 - DNA, 542 bp, Homo sapiens
  misc_feature: GZ8MTXP02JRTVZ.21.81.H04.1.454.CMB.2.raw
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctgtaccacaatacccaggcaaagcccccaaatcatcatttangatgtcagtatcggcctcgtagggtttctatcgtcttctctcggctcagtctggcaacncggcctcctgaccatctctgggctcgagctgatgacgaggctagattatactgctaggtcatactaacaatcagactaacgtacttagtgtcgttacgggactacgggaaccaaaggtactaccgaccgttaccgtaggtaccaaccgacccaacggtaccccaaacccgtacctcgtacctaccg

SEQ ID NO: 331860 - DNA, 511 bp, Homo sapiens
  misc_feature: GZ8MTXP02H764V.21.81.H04.1.454.CMB.2.raw
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (502)..(502): a, c, t, g, unknown or other
  misc_feature (502)..(502): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtacaacaataccaggcaaagccccaaatcatcatttangatgtcagtaatcggccctcgaggggtttcaaatcgcttctctcggctccaagtctggcaacncggcctcctcgaccatcnctgggcctccaggctgatgaaacgnggctgaattntactgctaggtcatatacaatcagcaaancttantcgttcggactgggaaccaagactcaccgtctaggtcaagccaacggccaaacccncgtctacac

SEQ ID NO: 331861 - DNA, 505 bp, Homo sapiens
  misc_feature: GZ8MTXP02HWBSS.21.81.H04.1.454.CMB.2.raw
  modified_base (242)..(242): a, c, t, g, unknown or other
  misc_feature (242)..(242): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaatcatcatttatgatgtcagtaatcggccctcaggggtttctaaatcgcttctctggctccaagtctggcaacncggctccctgaccatcnctgggctcaggctgatgaagaggctgattatactgcagtcatatacaatcagcaaancttaangtacttcgggactgggaaccaagatcaccgtctaggtcaagcccaaggccaacccactcgtacac

SEQ ID NO: 331862 - DNA, 560 bp, Homo sapiens
  misc_feature: GZ8MTXP02I070B.21.81.H04.1.454.CMB.2.raw
  modified_base (364)..(364): a, c, t, g, unknown or other
  misc_feature (364)..(364): n is a, c, g, or t
  modified_base (406)..(406): a, c, t, g, unknown or other
  misc_feature (406)..(406): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcgaggggtttctaatcgtcttctctcggctcaagtctggacaacncggcctccctgaccatctctgggcctccgaggctgatgacgnggctgattatactgctaggtcaatatacaatcagacaactacttatacgtcgttacgggacgtacggggaacctaaaggactaccaccgttacctacggtaccaaccgaccccgaaaggtacccccaaacccccgtactacggtacctaacccg

SEQ ID NO: 331863 - DNA, 565 bp, Homo sapiens
  misc_feature: GZ8MTXP02GE4GN.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaatacccaggacaaacgccccaaactcatcatttangatgtacagtaatcggcctgtaggggtttctaatcgcttctctcggctcaagtctggaccaacnccggcctcctgacctatctcgtcgggcctcgaggctgatgacgnggctagtattatactgtcaggtctaatataacaatcagactaactacttgtacgtcgttacggacgttacgggaacctaacggactaccgtaccgttaccgtacggtaccgaaccgacccgaaacggaccccaacccgtacttacggtacctaacccg

SEQ ID NO: 331864 - DNA, 524 bp, Homo sapiens
  misc_feature: GZ8MTXP02I6S23.21.81.H04.1.454.CMB.2.raw
  modified_base (301)..(301): a, c, t, g, unknown or other
  misc_feature (301)..(301): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggccaaacgcccccaaactcatcatttangatgtcagtaatccggccctgagggtttcatcgtcttctctacgctacaagtctgcacgcgcctcctacgaccatctcgtgggactccgtagctgggaactgacgagntntatatactagcagtananatanacactacatacactacttacgtactcggtacgacgtacggaccaacgtactacgaccgtacgtaaccgacgacgacccacgccaccactcg

SEQ ID NO: 331865 - DNA, 520 bp, Homo sapiens
  misc_feature: GZ8MTXP02I0MUC.21.81.H04.1.454.CMB.2.raw
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaacncatcatttatgatgtcagtaatcggccctcaggggtttctaatcgcttctctggctccaagtctggcaacncggcctccctgaccatctctgggctcgagctgatgacgaggctgattatctgcaggtcatatacaatcaagcaactacttatgtcttacgggacttagggaccaagcttacacgttcctaggtcaacgcccaaaggacccaacccgactacgtactacc

SEQ ID NO: 331866 - DNA, 524 bp, Homo sapiens
  misc_feature: GZ8MTXP02GHGTW.21.81.H04.1.454.CMB.2.raw
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
  modified_base (424)..(424): a, c, t, g, unknown or other
  misc_feature (424)..(424): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (510)..(510): a, c, t, g, unknown or other
  misc_feature (510)..(510): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaagcccccaaatcatcatttangatgtcagtaatcggccctnaggggtttctaatcgcttctctggctccaagtctggcaacncggccctcctgaccatctctgggctcgaggctgatgacgnggctgattatactgcagtcagtanacaatcagacaaacncttangtcgtacggactacgggaacaagactcgaccgtctaggtccaaggacccaaaggaccccaaacccnctacgtactaaccg

SEQ ID NO: 331867 - DNA, 540 bp, Homo sapiens
  misc_feature: GZ8MTXP02F4MGI.21.81.H04.1.454.CMB.2.raw
  modified_base (299)..(299): a, c, t, g, unknown or other
  misc_feature (299)..(299): n is a, c, g, or t
  modified_base (441)..(441): a, c, t, g, unknown or other
  misc_feature (441)..(441): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacggggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaatcatcatttangatgtcagtaatcggccctgagggtttctaatcgcttctctgcctccagtctggcaacacggcctcctgaccatctcgtgggctccaggctgatgacgaggctgattatactgacagtcatatacaatcaagcaacacttancgttcttacgggaacttaacggaccaaagtactaccgaaccgtcctaacggtccaacgaaccccgaaggaccccaaaccccgctcgtaccactttcccg

SEQ ID NO: 331868 - DNA, 542 bp, Homo sapiens
  misc_feature: GZ8MTXP02HGBMP.21.81.H04.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgacgttggtctttangactatgtctcctggtaccaacaataccaggacaaacgcccccaaactcatcatttatgatgtcagtaatcggcctcgaggggtttctaatcgcttctctcgctccaagtctgcaacncgcctcctgaccatcnctgggctccaggctgatgacgaggctagtattattactgcaggtctaatatacaatcaagacaaactacttatcgtactacgggactacggggaaccaaagcttaccgaccgtaccgtaaggtccaacgacccaaacggccccaaacccgtctacgtactaccg

SEQ ID NO: 331869 - DNA, 513 bp, Homo sapiens
  misc_feature: GZ8MTXP02GZRJW.21.81.H04.1.454.CMB.2.raw
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
  modified_base (501)..(501): a, c, t, g, unknown or other
  misc_feature (501)..(501): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttangatgtcagtaatcggccctcaggggtttctaatcgtcttctctcggctccaagtctggcaacncggcctcctgaccatctctgggctccaggctgatgacgaggctgattatactgctaggtcatatacaatcagacaactacttatgtcttcgggactgggaccaagatcaccgtctaggtcaagcccaacggccaacccnctcgtactaccg

SEQ ID NO: 331870 - DNA, 512 bp, Homo sapiens
  misc_feature: GZ8MTXP02JYUKE.21.81.H04.1.454.CMB.2.raw
  modified_base (242)..(242): a, c, t, g, unknown or other
  misc_feature (242)..(242): n is a, c, g, or t
  modified_base (357)..(357): a, c, t, g, unknown or other
  misc_feature (357)..(357): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacatacccaggcaaagcccccaaatcatcatttatgatgtcagtaatcggccctcgaggggtttcaatcgcttctctggctcaagtctggcaacncgcctcctgaccatctctgggcctccagctggatgagaggctgattatactgcaggtcatatacatcagcaacacttatgtctacgggactagggaccaagactacaccgtcctaggtccaacgccccaaggacccaaacccgctacgactaccc

SEQ ID NO: 331871 - DNA, 556 bp, Homo sapiens
  misc_feature: GZ8MTXP02GEH7V.21.81.H04.1.454.CMB.2.raw
  modified_base (243)..(243): a, c, t, g, unknown or other
  misc_feature (243)..(243): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctgaggggtttctaatcgcttctctcgctccaagtctggcaacncggcctcctgacccatctctcgggctccgaggctgatgacgaggctgattattactgcaggtcatatacaatcagcaaactacttatcgtacttcgggacttacggggaaccaaaggtactaccgaacccgttcctaagggttccaacggaccccgaaacggaccccaaacccccgacttacggtacctaacccg

SEQ ID NO: 331872 - DNA, 577 bp, Homo sapiens
  misc_feature: GZ8MTXP02FRDO7.21.81.H04.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactntgtctctgtaccaacaactaccaggacaaacgaccccaaactcatactatttatgatgtacaagtaactccggccctcgtacgggtttactaatcgtcttctcgtcgcctaccaagtctggaccaaacgccggccctccctacgacctattcctcgtcgggcctaccgaggctagatcggacgaggtctagtatttacttacgtgacgtaggtacaataactaacaatcaagactaaactacttagtcgttacgtacggactacgggaacaagactaccgaccgtcgtagtacaacgacccgaacgacccaaaccctacgtacgtactac

SEQ ID NO: 331873 - DNA, 525 bp, Homo sapiens
  misc_feature: GZ8MTXP02JAGMS.21.81.H04.1.454.CMB.2.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagccccaaactcatcatttangatgtcagtaatcggccctcaggggtttctaatcgcttctctcggctccaagtctggcaacncggcctccctgaccatctctgggctccaggctgatgacgaggctgattatactgctaggtcatatacaatcaagcaaactacttatgtcgttacgggactggggtaccaaggactccgaccgtacctaggtccaagcccaaacggcccaacccgactcgtctacc

SEQ ID NO: 331874 - DNA, 530 bp, Homo sapiens
  misc_feature: GZ8MTXP02GOKAR.21.81.H04.1.454.CMB.2.raw
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccccaggcaaagcccccaaactcatcatttangatgtcagtaatcggccctcaggggtttctaaatcgnttctctggctccaagtctggcaacncggcctcctgaccatctctgggctccgaggctgatgacgaggctgattatactgcaggtcatatacaatcagacaacacttatgttacttcggggaactgggaaccaaagactacgaccgtcctaggtccaacgcccaaacggccccaaacccactacgtactaaccg

SEQ ID NO: 331875 - DNA, 515 bp, Homo sapiens
  misc_feature: GZ8MTXP02G11EH.21.81.H04.1.454.CMB.2.raw
  modified_base (242)..(242): a, c, t, g, unknown or other
  misc_feature (242)..(242): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccaggcaaagcccccaaactcatcatttatgatgtcagtaatcggccctcgtaggggtttctaatcgcttctctcggctccaagtctggcaacncgcctcctgaccatctctgggctcgagctgatgacgagctgtattattactgcaggtcatactacaatcagacaatacttatgtctcggactggggaccaagctacaccgtctacgtcaacgtccaacggacccaacccgtctacgtactacc

SEQ ID NO: 331876 - DNA, 553 bp, Homo sapiens
  misc_feature: GZ8MTXP02H0IVO.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaatacccaggcaaacgcccccaaatcatcatttangatgtcagtaatcggccctgtaggggtttctaaatcgtcttctctggctccaagtctggacaacncggcctcctcgaccatctctgggcctccgaggctgatgacgaggctgattatactgcaggtcatatacaatcaagctaaactacttaatgtaccgtttacgggactacggggaacctaaacgactaccgtaaccgtccgttaaggtccaacgacccgaaacggcccaaaccccactacgtacctacccg

SEQ ID NO: 331877 - DNA, 538 bp, Homo sapiens
  misc_feature: GZ8MTXP02HMOYZ.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (428)..(428): a, c, t, g, unknown or other
  misc_feature (428)..(428): n is a, c, g, or t
  modified_base (525)..(525): a, c, t, g, unknown or other
  misc_feature (525)..(525): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaagcccccaaatcatcatttangatgtcagtaatcggccctgtaggggtttctaatcgcttctctgctccaagtctggcaacncggcctccctgaccatctctgggcctccgaggctgatgacgaggctgtattatactgcaggtctatanacaatcagacaactacttatgttcgttacgggacttacgggaaccaaaggactacgaccgtacctagggtaccaacgacccaaacggcccaaacccnctacgtactaccg

SEQ ID NO: 331878 - DNA, 551 bp, Homo sapiens
  misc_feature: GZ8MTXP02JXVDG.21.81.H04.1.454.CMB.2.raw
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcggggggtctcaggaggcagcgctctcgggacgtctccaccatggtctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttangatgtcagtaatcggccctgaggggtttctaatcgtcttctctcggctccaagtctggcaacnccggcctccctgaccatctctgggcctccaggctgatgacgaggctagtattattactgcaggtcatatacaatcagacaacacttatcgttcgtcgggactcggggaaccaaggtactaccgaccgttaccgtaacgggtaccaacgacccccgaacggaccccaaccccactacggtacctaacccg

SEQ ID NO: 331879 - DNA, 549 bp, Homo sapiens
  misc_feature: GZ8MTXP02F8C5A.21.81.H04.1.454.CMB.2.raw
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgcccccaaactcatcatttangatgtcagtaatcggccctgaggggtttctaatcgcttctctcgctccaagtctggcaacncggcctcctgaccatctcgtgggcctcgaggctgatgacgaggctagattatactgcaggtcatataacaatcagcaaatcttatcgtcgttacgggacttaggggaacccaaagtacgtacctaccgtacctacgggtaccaacggccccaaaacgggccccaaaccccgcgtacgtacctaacccg

SEQ ID NO: 331880 - DNA, 557 bp, Homo sapiens
  misc_feature: GZ8MTXP02IIIJJ.21.81.H04.1.454.CMB.2.raw
  modified_base (242)..(242): a, c, t, g, unknown or other
  misc_feature (242)..(242): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcggtgacgttggtctttangactatgtctctggtaccaacaatacccaggcaaacgcccccaaatcatcatttatgatgtcagtaatcggccctgtaggggtttctaatcgtcttctctcggcctccaagtctggacaacnccggcctccctcgacccatctcgtgggcctccgaggctgatgacgaggtctagtattattactgactaggtacatatacaatcagacaactacttagtgttcgttacgggactagggtaccaaagtactaccgtaccgtaccgttaaggccaacgacccgaaacggcccaaaacccgtactacgtactaaccg

SEQ ID NO: 331881 - DNA, 539 bp, Homo sapiens
  misc_feature: GZ8MTXP02G7GYG.21.81.H04.1.454.CMB.2.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgtttggtctttangactatgtctctggtaccaacaataccaggcaaagcccccaaatcatcatttatgatgtcagtaatcggcctctaggggtttctaatcgtcttctctcggctccaagtctggccaacnccggcctcctgaccatctctgggctccaggctgatgacgaggctgattatactgcaggtcatatacaatcagacaaacacttatcgtacgttcgggacgttcggggaaccaaggtactccgtaccgtcgtaacggtacaacgacccgaaacggcccaaaccccactcgtacctacccg

SEQ ID NO: 331882 - DNA, 537 bp, Homo sapiens
  misc_feature: GZ8MTXP02ID8UL.21.81.H04.1.454.CMB.2.raw
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (433)..(433): a, c, t, g, unknown or other
  misc_feature (433)..(433): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctggtacaacataccaggcaaagccccaaatcatcatttatgatgtcagtaatcggcctnaggggtttcaatcgcttctctgctccaagtctggcaacncggcctcctgaccatctntggctcaggtctgatgacgaggctgattatactgcaggtcatatacaatcaagcaactactttangttacgttcgggacttagggaaccaaaggtactacgtaacccgtccgttaggaccaacggaccccaaaagggccccaaaacccccgtctaacgttcctaacccg

SEQ ID NO: 331883 - DNA, 520 bp, Homo sapiens
  misc_feature: GZ8MTXP02FXRSB.21.81.H04.1.454.CMB.2.raw
  modified_base (294)..(294): a, c, t, g, unknown or other
  misc_feature (294)..(294): n is a, c, g, or t
  modified_base (441)..(441): a, c, t, g, unknown or other
  misc_feature (441)..(441): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctggtaccaacaataccaggcaaagccccaaatcatcatttangatgtcagtaatcggccctcaggggtttctaatcgcttctctggctccaagtttggcaacacggcctccctgaccatctctgggctccaggctgatgacgaggctgattatactgcaggtcatatacaatcaagcaaactactttangttcttcggggactagggaccaaagacttccacgtcctaggtcacgcccgaacggccaaaccccgactcgacacttccg

SEQ ID NO: 331884 - DNA, 586 bp, Homo sapiens
  misc_feature: GZ8MTXP02H8WBF.21.81.H04.1.454.CMB.2.raw
  modified_base (358)..(358): a, c, t, g, unknown or other
  misc_feature (358)..(358): n is a, c, g, or t
  modified_base (442)..(442): a, c, t, g, unknown or other
  misc_feature (442)..(442): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttatgactatgtctctggtaccacaataccaggacaaacgccccaaatcatcatttatgatgtcagtaatcggccctgaggggtttcaatcgcttctctcggctccgaagtctggacaacncggcccttccctcgaccctatcctcgtcgggcctccgaggtcctgaatgaacgaggtctagatttatactgactaggtcattanacaaatccaaagcctaaactacttagtacgtcgtttacgggacgttacggggaacctaaaggtactaccgtacccggtaccttaacggggtccaaacgtaccccgaaaacggccccaaaacccccgtgtccgttaaacctcccg

SEQ ID NO: 331885 - DNA, 572 bp, Homo sapiens
  misc_feature: GZ8MTXP02HB2JJ.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaatacccaggcaaacgcccccaaactcatcatttatgatgtcagtaatcggccctcgaggggtttctaatcgcttctctcggctccaagtctggcaacncggccctcctgaccatcnctgggctcagctgatgacgaggctgtattattactgctaggtcatatacaatcagacaactacttatcgttacgttcgggaacttacggggaaaccaaacggtactaccgtacccgttaccgtaacggttaccgaaccggtaccccgaaaaccgggaccccaaaaccccctcgtaccgttacctaaccccg

SEQ ID NO: 331886 - DNA, 513 bp, Homo sapiens
  misc_feature: GZ8MTXP02JEE42.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (463)..(463): a, c, t, g, unknown or other
  misc_feature (463)..(463): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacatacccaggcaaagcccccaaactcatcatttangatgtcagtaatcggcctcgaggggtttctaatcgnttctctgctcaagtctggcaacncgcctcctgacccatctctgggctccgaggctgatgacgaggctgattatacngcaggtcatataacaatcagacaacacttatgtctcgggactgggaccaaagntacaccgtctaaggtcaacggcccaaaggcccaacccgactcgtactacc

SEQ ID NO: 331887 - DNA, 526 bp, Homo sapiens
  misc_feature: GZ8MTXP02GWF6P.21.81.H04.1.454.CMB.2.raw
  modified_base (242)..(242): a, c, t, g, unknown or other
  misc_feature (242)..(242): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcggtgacgttggtctttangactatgtctctgtaccaacaataccaggcaaacgaccccaaactcatcatttatgatgtcagtaactcggccctcgtaggggtttctaatcgtcttctctcggctccaagtctgcaacncgcctcctcgaccatctctgggctcgagctgatgacgaggctgattatacgtagcaggtcatatacaatcagacaactattatgtcgtcggactgggacctaaacgactaccgaccgtcctaggtaccaacgtacccaaacggacccaacccacgtctactacc

SEQ ID NO: 331888 - DNA, 520 bp, Homo sapiens
  misc_feature: GZ8MTXP02JLVBS.21.81.H04.1.454.CMB.2.raw
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtacaacaatacccagcaaagccccaaactcatcatttangatgtcagtaatcggcctgaggggtttctaaatcgcttctctcggctccaagtctgcaacncgcctcctgaccatctctgggctccaggctgatgacgaggctgattatacttgcagtcatatacaatcagacaacactatgtctcggtacgtacggaccgaagactactaccgtaccgtacggtacgaacgacccgaacggaccaacccaacctactctaccc

SEQ ID NO: 331889 - DNA, 542 bp, Homo sapiens
  misc_feature: GZ8MTXP02HJB2M.21.81.H04.1.454.CMB.2.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (359)..(359): a, c, t, g, unknown or other
  misc_feature (359)..(359): n is a, c, g, or t
  modified_base (442)..(442): a, c, t, g, unknown or other
  misc_feature (442)..(442): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcncctgcactggaaccngcggtnacgttggtctttangactatgtctctgtaccaacaataccaggcaaagccccaaatcatcatttatgatgtcaagtaatcggcctacgtagggtttctaatcgtcttctctcgctcaagtctggacaacncgcctcctcgaccatctcgtcgggctccaggctgatgacgacggctagattactactgacgtaggtcaatactaacaatcganactaaactactttaatgtcgtttacgggacttaggggaacctaagacttccgacgtactaggtccaacgacccgaacgaccccaaccacgtctactaccc

SEQ ID NO: 331890 - DNA, 568 bp, Homo sapiens
  misc_feature: GZ8MTXP02GSJ69.21.81.H04.1.454.CMB.2.raw
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccagcaaacgcccccaaactcatcatttatgatgtcagtaactcggccctcgtaggggtttctaatcgtcttctctcggctcaagtctggcaacncggccctccacgaccactctcgtgggcctccaggctgatgacgaggctagtattattactgcaggtctaatatacaatcagacaactactttaatcgtcgttacggggacttacggggaacctaaaggtactaccgtaccgtaccgtacggtaccgaaccgacccgaaacggaccccaaaccccgaccgtacgtacctaacccg

SEQ ID NO: 331891 - DNA, 544 bp, Homo sapiens
  misc_feature: GZ8MTXP02G90MW.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaagcccccaaatcatcatttatgatgtcagtaatcggccctcgaggggtttctaaatcgcttctctcggctccaagtctggcaacncggcctcctgaccatctctgggcctcgaggctgatgacgaggctgattatactgcaggtctatatacaatccagcaacatttatgtacgttcgggacgttcgggaacccaaagtataccgaccgttacgtacggtacaaccggaccccaaacggcccaaaaccccacgtcgtaccctaaccg

SEQ ID NO: 331892 - DNA, 522 bp, Homo sapiens
  misc_feature: GZ8MTXP02GJ2FK.21.81.H04.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (359)..(359): a, c, t, g, unknown or other
  misc_feature (359)..(359): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactntgtctctggtaccaacaatacccaggcaaacgccccaaactcatcatttatgatgtcagtaatcggccctctaggggtttctaatcgcttctctgctccagtctggcaacncggcctccctgaccatctctgggctccaggctgatgacgaggctgtattattactgcaggtcatatacaatcagacaactacttatgtcgttcgggactcggggaacaaggactcaccgtcctaggtcaacgcccgaaacgcccaaccccactacgtactacc

SEQ ID NO: 331893 - DNA, 521 bp, Homo sapiens
  misc_feature: GZ8MTXP02HA11L.21.81.H04.1.454.CMB.2.raw
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaagcccccaaatcatcatttatgatgtcagtaatcggccctnaggggtttctaatcgtcttctctcgctccaagtctggcaacncggcctcctgaccatctctgggctcaggctgatgacgagctgtattattactgcaggtctatatacaatcagacaacacttatgtcgttcgggactacgggactaacgactacgaccgtacctagtcaacgccaaaaacggcccaacccactcgtactacc

SEQ ID NO: 331894 - DNA, 554 bp, Homo sapiens
  misc_feature: GZ8MTXP02I5M3Q.21.81.H04.1.454.CMB.2.raw
  modified_base (243)..(243): a, c, t, g, unknown or other
  misc_feature (243)..(243): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggcctcgagggtttctaatcgtcttctctggctccaagtctggccaacncggcctcccgtgaccatctctgggctccgaggctgatgacgaggctgaattattactgcaggtctaatactacaaagtcagacaaactactttatcgtacttcggggaactgggaaaccctaagaactccgtacccgtactacgggtacaacgaccccgaaacggcccccaaaccctacgtcgtcctaaccc

SEQ ID NO: 331895 - DNA, 565 bp, Homo sapiens
  misc_feature: GZ8MTXP02H3SB4.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaanaatacccaggcaaagcccccaaatcatcatttangatgtcagtaatcggcctgaggggtttctaatcgtttctntggcctccagtctggcaacgcgcctcctgacccatctcgngggcctccagctgatggacgaggctgtattatactgcaggtcaattatacaatcagacaactacttatcgtacgtcgggactcggggaaccaaaggtacttaccgaacccggttccgtaggttcccgaaccggaaccccgaaaacgggaccccaaacccccgtactaccgtaccctaaccttcccg

SEQ ID NO: 331896 - DNA, 709 bp, Homo sapiens
  misc_feature: GZ8MTXP02G03CC.21.81.H04.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaactaccagacaaacgccccaaactcatcatttatgatgtcagtaactcggtccctcgtacggggtttctaaacgtcgtcttctctcggtcctacctaagtcgtacggaccaacgccggtccctcccgtacgaccctacttcgtcgtcgggccttccgacggtcctaggtacttcggaacggtacggtaccgttaggttaatttacgttacgtacgcgtaaggttactaaattaacttaacgaattaccgaacgtacctaaaaccgttaactttagttacggtttaccgttaccggggtaaccgttacgggggaaaacctaaacggtaaccgtacccgttaacccggttacccgttaacggggttacccgtaaaccggacccccgtaaaacccgggtaacccccaaacccccggttaacctttccggtaaccctttaacccccg

SEQ ID NO: 331897 - DNA, 721 bp, Homo sapiens
  misc_feature: GZ8MTXP02GOATX.21.81.H04.1.454.CMB.2.raw
  modified_base (244)..(244): a, c, t, g, unknown or other
  misc_feature (244)..(244): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttagngactatgtctctcgtaaccaacaactaccagacaaacaccccaaactcatctatttatgatgtactagtaacgtccggtcctacgtagggtttactaatcgtcttctctcgtctaccgtaagtcgtacggaccaaacgccggtccctcctacgaaccctacttctcgtcgggtccctaccgacggtactagagtacgaacggacggtacgtagtaatttaacttacgtacggtacgtaacggtactaaacgttaaacttaaactaaacgtaaccgaaacgtaaacctaaaaccttaacgtttaacgttacggtttaccggttaaccggggtaaaccgttaaccggggtaaaaccctaaaacggtaaccgttaacccggtaacccgttacccggttaacggtaacccgaaacccggtaacccccgaaaaccggaaaccccctaaaacccccgtaaccgttaaccgttaccctaacccg

SEQ ID NO: 331898 - DNA, 539 bp, Homo sapiens
  misc_feature: GZ8MTXP02GFDKX.21.81.H04.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (360)..(360): a, c, t, g, unknown or other
  misc_feature (360)..(360): n is a, c, g, or t
  modified_base (402)..(402): a, c, t, g, unknown or other
  misc_feature (402)..(402): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaaccngcggtgacgttggtctttangactatgtctcctggtaccaacaataccaggcaaacgccccaaactcatcatttatgatgtcagtaatcggccctcgtaggggtttctaatcgcttctctcgctccaagtctggcaacncggcctcctgacctatctctcgggctccgaggctgatgacgnggctgtattattactgcaggtcatatacaatcagacaactacttatgtcgttacgggacttcgggaaccaaggactacacccgttacctaggtaccaacggaccccaacggacccaaacccctactcgttacaaccc

SEQ ID NO: 331899 - DNA, 543 bp, Homo sapiens
  misc_feature: GZ8MTXP02GHVHN.21.81.H04.1.454.CMB.2.raw
  modified_base (243)..(243): a, c, t, g, unknown or other
  misc_feature (243)..(243): n is a, c, g, or t
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (424)..(424): a, c, t, g, unknown or other
  misc_feature (424)..(424): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctgtaccaacaataccaggcaaacgccccaaactcatcatttatgatgtcagtaatcggcctnaggggtttctaatcgtctctctggctcaagtctggcaacncggacctcctgaccatctctgggctcgaggctgatgacgaggctgtaattattactgcaggtcatanacaatccagcaactacttatgttacgttacgggactacggggaaccaaagtactaccgtaccgtacccgtagggtaccaacggaccccgaacggaccccaacccactacgtcctaaccg

SEQ ID NO: 331900 - DNA, 545 bp, Homo sapiens
  misc_feature: GZ8MTXP02JPWKF.21.81.H04.1.454.CMB.2.raw
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
  modified_base (431)..(431): a, c, t, g, unknown or other
  misc_feature (431)..(431): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcggtgacgttggtctttatgactatgtctcctggtaccaacaatacccaggcaaagccccaaactcatcatttangatgtcagtaatcggcctctaggggtttctaatcgtcttctctcggctccaagtctggacaacncgcctcctgaccatctctgggcctccaggctgatgacgaggctagattattactgcaggtcatatanaatcagtacaaactacttatgttcgtacgggtactacggggaaccaaaggactacgaccgtaccgtacggtcaacgaccccgaaacggccccaaacccgactacgtacttaacc

SEQ ID NO: 331901 - DNA, 550 bp, Homo sapiens
  misc_feature: GZ8MTXP02I3XQU.21.81.H04.1.454.CMB.2.raw
  modified_base (243)..(243): a, c, t, g, unknown or other
  misc_feature (243)..(243): n is a, c, g, or t
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacataccaggcaaacgcccccaaactcatcatttatgatgtacagtaatcggccctcgtaggggtttctaaatcgtcttctctcggctccaagtctggaccaacnccggccctccctcgacccatctctgggcctccgaggctgatgacgngcngtattatactgctagtctatatacaatcagacaatacttagtgtcgtcggtactgggaaccaaaggactaccgaccgtaccgtaggtaccaacgaccccaacggaccccaaacccgactaccgtacctaacccg

SEQ ID NO: 331902 - DNA, 579 bp, Homo sapiens
  misc_feature: GZ8MTXP02HA2XM.21.81.H04.1.454.CMB.2.raw
  modified_base (319)..(319): a, c, t, g, unknown or other
  misc_feature (319)..(319): n is a, c, g, or t
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctggtaccaacaatacccaggcaaacgcccccaaactcatcatttatgatgtcagtaatcggcctntaggggtttctaatcgcttctctcggctccaagtctggccaacncggcctccctgaccatcctcgtcgggcctccgaggctggatgacgacggcttgattatactgctcggtaaaaactntaactacatacagtactaaactacgttagttacgtacgttacgggtaacgtacggaactaacgtacgtaccgtaccgtaccgtaacggtaccaaccgaacccgaaaccgacccctaaaccccgtactaccgtacctaccg

SEQ ID NO: 331903 - DNA, 558 bp, Homo sapiens
  misc_feature: GZ8MTXP02J5IR6.21.81.H04.1.454.CMB.2.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
  modified_base (368)..(368): a, c, t, g, unknown or other
  misc_feature (368)..(368): n is a, c, g, or t
  modified_base (441)..(441): a, c, t, g, unknown or other
  misc_feature (441)..(441): n is a, c, g, or t
tcagtcgtcgctcgcacgaccggtgctcgatttagtagtgtagattcgcggggggttctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtnacgttgtctttangactatgtctcctggtaccaacaaatacccaggcaaacgcccccaaactcatcatttatgatgtacagtaactcggcccctnaggggtttctaaatcgtcttctctcggctccaagtctggcaacncggcctccctgaccatctctcgggctccgaggctgatgacgagctgattatactgcaggtcatatacaatcancaacacttatgtcgttcgggactcggggaaccaacggactcgacccgtaccgttacgggtacccaacggacccccaaacggtaccccaaaacccccgtcgtaacgtccttaaccccg

SEQ ID NO: 331904 - DNA, 536 bp, Homo sapiens
  misc_feature: GZ8MTXP02I3OUS.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccacataccagcaaagccccaaatcatcatttangatgtcagtaatcggccctgaggggtttctaatcgtcttctctcgctccaagtctggcacncggcctcctgaccatctcngggctcagctgatgacgnggctgtattatactgcagtcatatacaatcagacaactacttatcgtacgttacgggacgttacgggaccaagtactaccacccgttccgtacggtaccaaccgacccgaacggaccccctaaacccgacgtacgtacctacccg

SEQ ID NO: 331905 - DNA, 582 bp, Homo sapiens
  misc_feature: GZ8MTXP02JR9ZW.21.81.H04.1.454.CMB.2.raw
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaactcatcatttangatgtcaagtaatcggccctgaggggtttctaaatcgcttctctcggctccaagtctggcaacncgcctcctgaccatctctgggcctcgaggctgatgacgagctgtattatactgctaggtcatatacaaatcaagctaaactcttaatcgttacgttacggggacttacggggaaacctaaacggtactaccgtaacccgttccgtaagggttacccaacggacccccgaaaacggggccccctaaaacccccgtacttaccggttacctaaaccccg

SEQ ID NO: 331906 - DNA, 528 bp, Homo sapiens
  misc_feature: GZ8MTXP02G9EKP.21.81.H04.1.454.CMB.2.raw
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
  modified_base (435)..(435): a, c, t, g, unknown or other
  misc_feature (435)..(435): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcggtgacgttggtctttangactatgtctcctggtaccaacaatacccaggcaaagcccccaaatcatcatttangatgtcagtaatcggcctcgaggggtttctaatcgcttctctggctccaagtctggcaacncggcctcctgaccatctctgggcctccaggctgatgacgaggctgattattactgcaggtctaatatacaatccaanactaactacttagtcgtacgttacggactaggaaccagactaccgaccgtactacggacaaccggaccaacgacccaacctactacgtactac

SEQ ID NO: 331907 - DNA, 548 bp, Homo sapiens
  misc_feature: GZ8MTXP02GB2AX.21.81.H04.1.454.CMB.2.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (498)..(498): a, c, t, g, unknown or other
  misc_feature (498)..(498): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggacaaacgcccccaaatcatcatttangatgtcagtaatcggccctcgtaggggtttctaatcgcttctctcggtcctaccaagtctggacaacgaccggcctccctcgacccatctcgtcgggcctccgaggtctgatgacgaggtctagtattatactgcaggtctaatataactaatcaagacaaactacttatgtcgttacgggactacgggacaacgntctaccgtctacggtcaacgcccgaacggcccaaacccncncgtactacc

SEQ ID NO: 331908 - DNA, 559 bp, Homo sapiens
  misc_feature: GZ8MTXP02HPZLW.21.81.H04.1.454.CMB.2.raw
  modified_base (243)..(243): a, c, t, g, unknown or other
  misc_feature (243)..(243): n is a, c, g, or t
  modified_base (369)..(369): a, c, t, g, unknown or other
  misc_feature (369)..(369): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaaacgcccccaaaactcatacatttatgatgtacagtaatcggccctcgtaggggtttctaatcgtcttctctggctccaagtctggcaacnccggcctcctgaccatctcgtgggctccaggctgatgacgaggcttagtattatactgcagtcatatacaatcagacaacacttatcgtctcgggtactcggggaaaccaagtactcgtacccgtaccgtaagggttccaacggaccccgaaacggaccccaaaaccccgtctaccgttaccttaacccg

SEQ ID NO: 331909 - DNA, 611 bp, Homo sapiens
  misc_feature: GZ8MTXP02FWZ0U.21.81.H04.1.454.CMB.2.raw
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctgtaccaacatacccaggcaaacgcccccaaacntacattatanatntnataagtacgtcccgtcgtacgggttacgttaactacgtccgttactctcggcctcctaacgtacgtcgacgaaccacggccgtccctcgtaccactctcgtcggtcgtccacgacgtgagtagtacggagcgtactaagttattaacgttgtacgacggtatactaataacaaactacacgacaactaacttatacgttcgtttacgggaacgtacggaaaccgaaacgtaacgtacctacccgtaccgttacggtacgaccgaacccgaaaccggaacccaaccccaacctacgtaccaaccttccg

SEQ ID NO: 331910 - DNA, 606 bp, Homo sapiens
  misc_feature: GZ8MTXP02JNXWH.21.81.H04.1.454.CMB.2.raw
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaanaatacccaggcaaacgcccccaaactcatcatttangatgtcagtaatcggccctcgaggggtttctaatcgtctctctcggctcaagtctggacacncggcctcctagaccatctctgggacctccgaggctcgatgacgaggctagtattactacgtgacgtaggtactaattaataacaaattaccgaacgtacctaaacgtactttaactcggttacgttaccggggtacgtacggggaaacctaaacggtacttacccggaacccgttacccgtaacggttaccgaacgtaacccccgaaacggaccccaaacccctacgttacgtacctaacccg

SEQ ID NO: 331911 - DNA, 552 bp, Homo sapiens
  misc_feature: GZ8MTXP02J3ICA.21.81.H04.1.454.CMB.2.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
  modified_base (451)..(451): a, c, t, g, unknown or other
  misc_feature (451)..(451): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccngcggtnacgttggtctttangacttatgtctcctggtaccaacaaatacccaggacaaacgcccccaaactcatcatttatgatgtcagtaatcggcctnagggtttcaatcgcttctctcgctcaagtctgacaacncgcctccctgaccatctctcgggctccgaggcctagacgtgacggaggtctaggtaactttattacgtgctaggtcaatataacaatacanacaaactacgttatcgtacgttacggactacgggaaccaagacttaccgaccgtaccttaacggcaacgacccgaacgacccaaacccgctacgtctaccg

SEQ ID NO: 331912 - DNA, 627 bp, Homo sapiens
  misc_feature: GZ8MTXP02IG7WS.21.81.H04.1.454.CMB.2.raw
  modified_base (223)..(223): a, c, t, g, unknown or other
  misc_feature (223)..(223): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtcttatgactatgtctctgtacaacataccagacaaacgccccaaancatcatttangtatgtctagtaactccggcctcgtaggggtttactaatcgtcttctctcgtcctacctaagtctggaccaacnccgggtcccttccctacgacctactctcgtcgggctccgagtctgatcgacgacggtctagtacttatctaggatacggtactattaactacaaatcaacgtaactaacctatttaacgttcgtacgtttaccggggtaacgttacggggaaacctaaacggtaaacctaccgtaacccggtttaccgtaacgtaccgtaaccggaacccccgtaaaccggaccccaaacccccgtacgttaccgtaacccgttaacccg

SEQ ID NO: 331913 - DNA, 556 bp, Homo sapiens
  misc_feature: GZ8MTXP02IA8G5.21.81.H04.1.454.CMB.2.raw
  modified_base (223)..(223): a, c, t, g, unknown or other
  misc_feature (223)..(223): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttatgactatcgtctcctggtaccaacaataccccaggacaaacgcccccaaactcatcatttatgatgtacagtatcggccctgtaggggtttctaatcgtcttctctcggctccaagtctggcaacgcgccctcctgacccatctctcgggcctccgagctgatgacgaggctagtattatactgcaggtcaatatacaatcagactaactacttatcgtacgttacgggacgttacgggactaaacgtactacgacccgttcgtaaggtccaaccgacccaaacggcccctaaacccgacgtacgtactacccg

SEQ ID NO: 331914 - DNA, 557 bp, Homo sapiens
  misc_feature: GZ8MTXP02HRI9R.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (373)..(373): a, c, t, g, unknown or other
  misc_feature (373)..(373): n is a, c, g, or t
  modified_base (447)..(447): a, c, t, g, unknown or other
  misc_feature (447)..(447): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaacgcccccaaactcatcatttatgatgtcaagtaatccggcccctcgtaggggttttctaaatcgtcttctctcggctccaagtctggaccaacnccggcctcctcgaccatctctgggctccgaggctgatgacgaggctgattatactgctagtcatatacaatcanactaactacttatgtcgttacgggacttacgggaaccaaacggtactaccgacccgttccgtaacggtacaacgacccaaacggaccccaaaccccgactcgtacctacc

SEQ ID NO: 331915 - DNA, 533 bp, Homo sapiens
  misc_feature: GZ8MTXP02I8HLZ.21.81.H04.1.454.CMB.2.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttggtcttangactatgtctctggcacaacaatacccaggacaaacgccccaaactcatcatttatgatgtacagtaatcggccctcgtagggtttctaatcgcttctcctgctcaagtctgacacacggcctcctacgaccatctctcggctaccgagctgagtgacgaggtctgattatactgctagtcatatacaatcagtacaaacacttatcgcgttacggactagggaccaaagtactacaaaccgttcctaagggtccacgacccgaaacggacccaaacccgtactcgtaaccc

SEQ ID NO: 331916 - DNA, 489 bp, Homo sapiens
  misc_feature: GZ8MTXP02IAKI9.21.81.H04.1.454.CMB.2.raw
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctggtacacaataccaggcaaagctccaaactcatcatttatgatgtcagtaatcggccctcaggggtttctaatcgcttctctgctcaagtctggcacacggctccctgaccatctctgggctccagctgatgacgaggctgtattattactgcaggtcatatacaatcagcaacacttatgtcttcggactgggacaagactcaccgtcagtcagccacgaccaacccactcgtac

SEQ ID NO: 331917 - DNA, 558 bp, Homo sapiens
  misc_feature: GZ8MTXP02II8RE.21.81.H04.1.454.CMB.2.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatcncctgcactggaaccngcggtgacgttggtctttangactatgtctctggtacaacaataccagcaaacgccccaaactcatcatttangatgtcagtaatcggccctcgtaggggtttctaatcgcttctctcgctccaagtctggcaacncggcctcctcgaccatctcgtgggctcgaggctgatgacgaggtctgtattattactgcctaaggtctaatatacaatcagtacaaactacttatacgtcgttacgggacttaggggaaacccaagtaactaccgtaccgtaccgttaggtaccaacggaccccgaaacggccccaaaacccctctaccgtacctaacccg

SEQ ID NO: 331918 - DNA, 538 bp, Homo sapiens
  misc_feature: GZ8MTXP02FVW1X.21.81.H04.1.454.CMB.2.raw
  modified_base (243)..(243): a, c, t, g, unknown or other
  misc_feature (243)..(243): n is a, c, g, or t
  modified_base (301)..(302): a, c, t, g, unknown or other
  misc_feature (301)..(302): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaacgcccccaaaactcatcatttannatgtcagtaatcggccctcgtaggggtttctaatcgcttctctcggctcaagtctggcaacnccggcctccctgaccatctcgtcgggctccgaggtctgagtgacgagtctgtattagtactgcgaggtcatatacaatcagacaactacttatcgtcgttacggactcgggaaccaagactacaccgtactacggtacgaacgcccaacggacccaaacccactcgtactaccg

SEQ ID NO: 331919 - DNA, 658 bp, Homo sapiens
  misc_feature: GZ8MTXP02H335S.21.81.H04.1.454.CMB.2.raw
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttgtctttatgactatgtctcctggtaccaacaaactacccaggaccaaaacgccccaaatcatcatttatgatgtcagtaatcggcctgtagggtttctaatcgtcttctctcgctaccaagtctacggcaacgccggtccctccctcgacctatccgtcgttcgggaccttccgaggctagagtcggaacggacggtcttaggtaacttttacgttaacgtgaccgttaaggtacctaaattaataacctaagttacaacggaactaaaccttaactttaattcggtttaccgtacccgggggttaacgtaaccgggggtaacctaaaacgtaccgtacccgtaaacccggttccgtaaccggtaccgaaccggacccgaaaaccggaccccctaaaccccgtactaccggtttaccctaacccg

SEQ ID NO: 331920 - DNA, 554 bp, Homo sapiens
  misc_feature: GZ8MTXP02GFZC1.21.81.H04.1.454.CMB.2.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaagcccccaaaatcatcatttangatgtcagtaatcggccctcgaggggtttctaatcgcttctctcggctccaagtctggcaacncggcctccctgaccatctctgggctccaggctagatgacgaggctgattatacngcagtcatatacaatcagactaacacttatgtcgttacggggacttcggggaaaccaaaggtaacttccgaacccgttcctaagggtcccaacggacccccgaaaacggcccccaaaacccccattccggtacctaacc

SEQ ID NO: 331921 - DNA, 541 bp, Homo sapiens
  misc_feature: GZ8MTXP02GDFLH.21.81.H04.1.454.CMB.2.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaatcatcatttangatgcagtaatcggccctgagggtttctaatcgcttctctcggctccaagtctggcaacncgcctcctgaccatctctgggctccaggctgatgacgngctgattatactgacaggtcatatacaatcaagcaacacttatcgtcgttcgggacttacggggaaccaaagtactaccgtaccgtaccgtaggtaccaacgaccccgaaacggaccccaaacccgtactacgtacctaacccg

SEQ ID NO: 331922 - DNA, 628 bp, Homo sapiens
  misc_feature: GZ8MTXP02I8DJ1.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaacgcccccaaactcatcatttangatgtacagtaatcggccctcgtaggggtttctaatcgtcttctctcggcctccaagtctggaccaacncggccctccctgacccatctcgtgggcctccgaggctgatgacgacggctagtaattacgttacctgacgtacggtctaattactaactaaatccaacgtacaaaacccttactttagttcgttaccgtttcggggtaaacgttcgggggaaacccaaaggtaccttacccgacccggttacccgttaagggttacccgaacggtacccccaaaacggggacccccaaaacccccgtcttaccggtaccttaaacccg

SEQ ID NO: 331923 - DNA, 647 bp, Homo sapiens
  misc_feature: GZ8MTXP02HSGJL.21.81.H04.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaactaccaggcaaactccccaaactcatctatttatgtatgtcaagtaactccggtcccttacgtacggggtttactaagtccgtcttctcgtcggtctaccgtaagtcgtgaccaaacgccggtaccctcccacgaccctactcctcgtcgggccttccgaggtctgacgttcgaacggtcggtcttagaacgtttacgttaactgtacgtagtactaaattaactaacaaactacaacgtaacctaaacttaacttacgttacgttaccgttaccggggtaacgtacggggtaaaccaaacggtacctacctacccgtacgtaacggtaccgaaccgacccgaaacggtaccccaaaacccctcgtaccgttctaacccc

SEQ ID NO: 331924 - DNA, 525 bp, Homo sapiens
  misc_feature: GZ8MTXP02FLTH7.21.81.H04.1.454.CMB.2.raw
  modified_base (363)..(363): a, c, t, g, unknown or other
  misc_feature (363)..(363): n is a, c, g, or t
  modified_base (436)..(436): a, c, t, g, unknown or other
  misc_feature (436)..(436): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaaatcatcatttatgatgtcagtaatcggcctcaggggtttctaaatcgcttctctcggctccaagtctggacaacncggcctccctgaccatctctgggcctccaggctgatgacgaggctgattatactgcagtcatatacatcaganaacactatgtctcggtacgtaggacgaacgaactacaccgtaccgtacgtacgaacgaccgaacggaccaaccccacctacgtactacc

SEQ ID NO: 331925 - DNA, 534 bp, Homo sapiens
  misc_feature: GZ8MTXP02J0N3I.21.81.H04.1.454.CMB.2.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (522)..(522): a, c, t, g, unknown or other
  misc_feature (522)..(522): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaataccaggcaaacgcccccaaactcatcatttangatgtcagtaatcggccctcgaggggtttctaatcgcttctctcggctcaagtctggcaacncgcctcctgaccatctctgggctccgaggctgatgacgagctgattatactgcaggtcatatacaatcaagtcaaactacttaagtcgtcgttacgggactcggggaaccaaggaactccaacccgtcctaaggtccaacggacccaacggcccaaaccccnctcgtactaccc

SEQ ID NO: 331926 - DNA, 594 bp, Homo sapiens
  misc_feature: GZ8MTXP02HI6KB.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (382)..(382): a, c, t, g, unknown or other
  misc_feature (382)..(382): n is a, c, g, or t
  modified_base (441)..(441): a, c, t, g, unknown or other
  misc_feature (441)..(441): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaacgcccccaaactcatcatttatgatgtcagtaatcggccctgtaggggtttctaatcgtcttctctcgctctaagtctggcaacgccggcctcctgaccatcncgtgggctcgagctgatgacgaggctagtattatactgcaggtctaatatacaatcganacaaactacttaagtgttacgttacggggtacgttacgggggaaacctaaaggacttaccgaaacccggttaccgttaacgggttacccaaccggaaccccgtaaaaccgggacccccaaaaacccccggtcgtaccgttacccgtaaccccg

SEQ ID NO: 331927 - DNA, 583 bp, Homo sapiens
  misc_feature: GZ8MTXP02G9X7V.21.81.H04.1.454.CMB.2.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
  modified_base (563)..(563): a, c, t, g, unknown or other
  misc_feature (563)..(563): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggacaaacgccccaaactcatcatttangtatgtcagtatcgcctcgaggggtttctaactcgtcttctactcggtctccaagtctggacaacncggcctcctgacccatctctcgggctccgaggctgatgacgaggctgattattacngcaggtcaattanactaatcaacgactaaactactttaagtaggttcgttacgggtacgttacggggaaccctaaaggtactacccgtaccgtaccgtaaggtaccaaccgaccccgaaaacggacccccaaaacccccncgttaccgtaccttaacccg

SEQ ID NO: 331928 - DNA, 557 bp, Homo sapiens
  misc_feature: GZ8MTXP02JAMWV.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggcaaagccccaaactcatcatttangatgtcagtaatcggccctcgtaggggtttctaatcgtcttctctcgctccgaagtctggacaacncggccctcccgtgaccatctacgtcgggcctccgaggctgatgacgagctgtattatactgcaggtcaatacgtactaatcagactaactacttatgttacgtcggacgttagggaacctaaagacttacgaccgttacgtaggtaccaacgacccgtaacggaccccaaacccgtacgtacgtacctaacc

SEQ ID NO: 331929 - DNA, 551 bp, Homo sapiens
  misc_feature: GZ8MTXP02I7KL4.21.81.H04.1.454.CMB.2.raw
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcggtgacgttgtctttangactatgtctctggtaccaacaataccaggcaaacgcccccaaactcatcatttangatgtcagtaatcggcctcgagggtttctaatcgtcttctctcgctccaagtctggaccaacncggcctcctgacccatctcgtgggcctccgaggctgatgacgaggctgtattattactgcaggtcatatacatacagacaactactttatgttcgttacgggactaggggtaaccaaaggtactaccgtacccgtacctacggtaccaacgcccgaaacggaccccaaaacccctcgtaccgtctaacccg

SEQ ID NO: 331930 - DNA, 628 bp, Homo sapiens
  misc_feature: GZ8MTXP02ID36T.21.81.H04.1.454.CMB.2.raw
  modified_base (382)..(382): a, c, t, g, unknown or other
  misc_feature (382)..(382): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataaccaggacaaacgccccaaactcatcatttatgtatgtcaagtaatccggccctagtaggggtttactaaacgtcgtacttctctccggcttacccgaagtctacggacaacnccgtcctccctcgacctactctctcggggaccttccgaggtctacgagtcgacgaggtctaggtaactttacgttacgtagtacgaaggttctaaagttaactaaccgtaaataccaagtaaccaaaccttacttaactcggttacgttaccgggtacgtacgggaacccgaaagtactaccgtaccgtaccgtaaggtacccgaacgtacccgaaacggacccaaccctactaccgtactacccg

SEQ ID NO: 331931 - DNA, 621 bp, Homo sapiens
  misc_feature: GZ8MTXP02GX8UV.21.81.H04.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcactggaaccngcggtgacgttgtctttangactatgtctctgactacaacaataccagacaaacgccccaaactcatcatttatgatgtacagtaactcggtccctcgtagggtttctaactcgtcttctcctggcctcaagtcgtaggaccacgaccggtcctcccgtacgacctagtcctcgtcgggccttaccgacggtccgtagacgttggaaccggtaggtccttaggtaatttacgttaacgtcgtacgtacggttactaattaactaactaaactacgaactaactaaacttactttaagtcgttaccgttacggggacgttaggaacccgtaaaggtactaccgtaacccgtcgtaacgtaaccgaccgaccgaaccggaacccaaccctactacgtacccg

SEQ ID NO: 331932 - DNA, 572 bp, Homo sapiens
  misc_feature: GZ8MTXP02HCIRZ.21.81.H04.1.454.CMB.2.raw
  modified_base (244)..(244): a, c, t, g, unknown or other
  misc_feature (244)..(244): n is a, c, g, or t
  modified_base (444)..(444): a, c, t, g, unknown or other
  misc_feature (444)..(444): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggcggtgacgttggtctttangactatgcctcctggtaccaaacaataccccaggaccaaacgcccccaaactcatctatttatgatgtacaagtaatccggccctacgtaggggtttactaaatccgtcttctctccggtctccaagtctggaccaacgccggccctcctcgacctatcctcgtcgggctcgaggctgatgacgagctgtattactacgngcagtcaatactaacaatcagtacaactattagtagtcgttacgggactacgggaactaacgtactaccgtaccgtacgtacggtacaaccgtacccgaacggacccaacccctacgtcaccttaccc

SEQ ID NO: 331933 - DNA, 543 bp, Homo sapiens
  misc_feature: GZ8MTXP02FWYOW.21.81.H04.1.454.CMB.2.raw
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctgtacaacataccaggcaaagccccaaancatcatttangatgtcagtaatcggcctgaggggtttctaatcgcttctctcggctccaagtctggcaacgcggcctccctgacccatctctgggctccgaggctgatgacgngctgattatacgngcaggtcatanacaaatcagtacaactacttatagttcttacgggggactacggggtaaccaaagtacgtaccacccgttccgtaaggtccaacggaccccgaaacggcccaaacccctacgtacgtactaaccc

SEQ ID NO: 331934 - DNA, 581 bp, Homo sapiens
  misc_feature: GZ8MTXP02JSLJS.21.81.H04.1.454.CMB.2.raw
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
  modified_base (410)..(410): a, c, t, g, unknown or other
  misc_feature (410)..(410): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggcggtgacgttggtctttangactatgtctcctggtaccaacaatacccaggcaaacgcccccaaatcatcatttangatgtcagtaatcggcccttcgaggggtttctaatcgtcttctctcggctcaagtctggcaacncggcctcctgaccatctcgtcgggtcctccgaggtctgatgacgnggctagtaattacttacgtgctaggtcattactaacaatcagacaaacgtactttagtcgttaccgtacgggtacgttacggggaaacctaaacggtactaccgtaaccgtccgtaacggtaccgaacgaccccgaaacggtccccaaaaccctcgtacgtacctaacccg

SEQ ID NO: 331935 - DNA, 535 bp, Homo sapiens
  misc_feature: GZ8MTXP02GF8SR.21.81.H04.1.454.CMB.2.raw
  modified_base (243)..(243): a, c, t, g, unknown or other
  misc_feature (243)..(243): n is a, c, g, or t
  modified_base (366)..(366): a, c, t, g, unknown or other
  misc_feature (366)..(366): n is a, c, g, or t
  modified_base (435)..(435): a, c, t, g, unknown or other
  misc_feature (435)..(435): n is a, c, g, or t
  modified_base (523)..(523): a, c, t, g, unknown or other
  misc_feature (523)..(523): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccaggcaaacgccccaaactcatcatttatgatgtcagtaatcggcctcgaggggtttctaagtcgcttctctcggtcctaccaagtctggcaaacncggcctccctagaccatctcgtcgggctccaggctgactgacgaggctgattatactgcagtcatatanatcagacaacacttatgtcgttacgggactacggggaacaacgtactccgaccgtcgtaggtacaacggcccaaacggacccaacccnctactctaaccc

SEQ ID NO: 331936 - DNA, 569 bp, Homo sapiens
  misc_feature: GZ8MTXP02GNSAL.21.81.H04.1.454.CMB.2.raw
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
  modified_base (443)..(443): a, c, t, g, unknown or other
  misc_feature (443)..(443): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggccaaacgcccccaaactcatcatttangatgtcagtaatcgcctcgtaggggtttctaatcgcttctcgtcggcctaccaagtctggaccaacnccggcctccctgacccatctcgtcgggctccgaggctgatgacgaggctagtattatactgcaggttcagttanaacaatcaagacaaactacttatacgtcgttacgggaacgtcgggaaaccaaagtacctacgtacccgtaccgtaggtaccaacgaccccgaaacggacccaaacccccgtactacgtacctaacc

SEQ ID NO: 331937 - DNA, 548 bp, Homo sapiens
  misc_feature: GZ8MTXP02JSDLZ.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
  modified_base (457)..(457): a, c, t, g, unknown or other
  misc_feature (457)..(457): n is a, c, g, or t
  modified_base (533)..(533): a, c, t, g, unknown or other
  misc_feature (533)..(533): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcggtgacgttggtctttangactatgtctcctggtaccaacaataccccaggcaaacgcccccaaactcatcatttatgatgtcagtaatccggccctcgtacggggttttctaaatcgctttctcgtcggctaccaagtctggaccaacnccgggccctccctcgaccatctctcgggctccaggctgatgacgngctagattattactgtacaggtctatatacaatcgaanacaactactatgtactcggactgggactaagactacgaccgtacctagtcaacgacccgaacggaccccaaacccnccgtactcctaaccg

SEQ ID NO: 331938 - DNA, 528 bp, Homo sapiens
  misc_feature: GZ8MTXP02JR1HH.21.81.H04.1.454.CMB.2.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (435)..(435): a, c, t, g, unknown or other
  misc_feature (435)..(435): n is a, c, g, or t
  modified_base (516)..(516): a, c, t, g, unknown or other
  misc_feature (516)..(516): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaatcatcatttangatgtcagtaatcggccctnaggggtttctaatcgcttctctggctcaagtctggcaacncgccctccctgacccatctctcgggcctccaggctgatgacgaggctgattatactgcaggtcatatacaatcgaanacaatatatgtcgtacggtacgtacggaaccaaagactactaccgtacgtaggtaccaacgacccgaaacgacccaacccncgtacgtacacg

SEQ ID NO: 331939 - DNA, 592 bp, Homo sapiens
  misc_feature: GZ8MTXP02G6K8R.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
  modified_base (300)..(301): a, c, t, g, unknown or other
  misc_feature (300)..(301): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccnggcggtgtacgttgtcttangactntgtctctgtaccaacaataccaggacaaacgccccaaancatactatttannatgtacaagtaacgtcggtccctagtacgggtttactaagtccgtcttctctcgtctacagtctaggcaacgccgcctccncgacctntcgtcgtcgggcctcgaggtctagagtgacgtaggtctagtacttattcgagcgtaagtactaatactaactaatacgaactaactaaacttacgtttagttacgttacgtacgggtaacgtacgggaactaaacggcttaccgaccgttacgtacgaccaaccgacccgaacggaccccaacccgtacgtactacctacccg

SEQ ID NO: 331940 - DNA, 560 bp, Homo sapiens
  misc_feature: GZ8MTXP02GTL65.21.81.H04.1.454.CMB.2.raw
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
  modified_base (420)..(420): a, c, t, g, unknown or other
  misc_feature (420)..(420): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggcggtgacgtttggtctttangactatgtctctggtaccaacaataccaggcaaacgccccaaactcatcatttangatgtcagtaatcggccctgtaggggtttctaatcgtcttctctggctccaagtctggacaacncggcctccctgaccatctctgggctccgaggctgatgacgacggctgattattacngcaggtcatatacaatcagacaactacttatcgtcgttacgggaacttcggggaaaccaaaggtactacgtaacccggtacctacggggtacaacgaccccgaaacggaccccaaacccccacgtacggttacctaaccg

SEQ ID NO: 331941 - DNA, 611 bp, Homo sapiens
  misc_feature: GZ8MTXP02HNSJE.21.81.H04.1.454.CMB.2.raw
  modified_base (223)..(223): a, c, t, g, unknown or other
  misc_feature (223)..(223): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttatgactatgtctcctggtaccaacaatacccaggacaaacgcccccaaactcatcatttatgtatgtcaagtaatcggccctgtaggggtttctaatcgtcttctctggcctccaagtctggacaacgaccggccctaccctgaccctattcctcgtcgggccttacccgaggtctacggatcgaacggtaggtcttaggtaatttacgttacgtggtctaaggttctaaatataactaaatcaagactaaactacttaattcggtacgttacgggaacgttacggggaacctaaagtactacctaccgtaccgtacggtacaaccgtacccgaaaacggtaccccaaaccctacgtacgtacctaaccc

SEQ ID NO: 331942 - DNA, 604 bp, Homo sapiens
  misc_feature: GZ8MTXP02H2AIP.21.81.H04.1.454.CMB.2.raw
  modified_base (223)..(223): a, c, t, g, unknown or other
  misc_feature (223)..(223): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttggttctttatgactatgtctcctggtaccaacaatacccaggcaaacgcccccaaactcatctatttatgatgtacagtaactcggccctcgtaggggtttctaatccgtctctctgctcagtctggcaacncggcctccncgacatcntggctcaggctgntgacgagctagattatactgcgtaggtcaattataacaattcaagactaaaccactttaatcgttaccgttacggggtaccgttacgggggaaaccctaaaggtaaccttacccgtaacccggttacctttaaacggggtaccaaccggaaccccgtaaaccgggacccccaaaacccccggtaccttaccggttaacccttaccccg

SEQ ID NO: 331943 - DNA, 537 bp, Homo sapiens
  misc_feature: GZ8MTXP02J3T3H.21.81.H04.1.454.CMB.2.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (369)..(369): a, c, t, g, unknown or other
  misc_feature (369)..(369): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcggtnacgtttgtctttatgactatgtctcctggtaccaacaaatacccaggcaaacgcccccaaactcatcatttatgatgtcagtaatcggcccctcaggggttttctaatcgtcttctctcggctccagtctggccaacncggcctccctgaccatctctcgggctccgaggctgatgacgaggctgatttatactgcagtcatatacatcagacaacacgttatgtcgttcggggactggggaccaagactctaccgttctacggtccaacgacccaacggaccccaaccccacgttcaccttaccc

SEQ ID NO: 331944 - DNA, 538 bp, Homo sapiens
  misc_feature: GZ8MTXP02ILWTW.21.81.H04.1.454.CMB.2.raw
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttatgactatgtctcctggtaccaacatacccaggcaaacgcccccaaactcatcatttangatgtcagtaatcggccctcgaggggtttctaaatcgcttctctcggctccaagtctggccaacncggccctccctgacctatctctcgggctccaggctgatgacgaggctgtattatctgcaggtcatatacaatcagacaactacttatcgtcgttacgggactagggaaccaaggtactacgaccgttaccaggtccaacgacccctaacggacccaaccccacgtctacctacc

SEQ ID NO: 331945 - DNA, 542 bp, Homo sapiens
  misc_feature: GZ8MTXP02IVCRU.21.81.H04.1.454.CMB.2.raw
  modified_base (243)..(243): a, c, t, g, unknown or other
  misc_feature (243)..(243): n is a, c, g, or t
  modified_base (360)..(360): a, c, t, g, unknown or other
  misc_feature (360)..(360): n is a, c, g, or t
  modified_base (408)..(408): a, c, t, g, unknown or other
  misc_feature (408)..(408): n is a, c, g, or t
  modified_base (511)..(511): a, c, t, g, unknown or other
  misc_feature (511)..(511): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccaggcaaagccccaaactcatcatttatgatgtcagtaatcggcctcgtaggggtttctaatcgcttctctcgctccaagtctgccaacnccggtcctcctcgaccatcctctcgggcctcgacggctagatgaacgngggtctagtatttattacgtggacctaggtctatactacaaatcgacgacaaactacttatcgtcgtacggactgggaaacctagactcaccgtctacggtanaacgccaacggaccctaaccacgtctctacc

SEQ ID NO: 331946 - DNA, 527 bp, Homo sapiens
  misc_feature: GZ8MTXP02F8EAZ.21.81.H04.1.454.CMB.2.raw
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (369)..(369): a, c, t, g, unknown or other
  misc_feature (369)..(369): n is a, c, g, or t
  modified_base (454)..(454): a, c, t, g, unknown or other
  misc_feature (454)..(454): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttttangactatgtctcctggtaccaacaataccccaggcaaaacgcccccaaaactcatcatttangatgtcagtaatcggccctcaggggtttctaaatcgnttctctcggctccaagtctggacaacncggcctccctgacccatctctgggctccgagctgatgacgaggctgattatactgcaggtcatatacaaatcagacaacactatntctcggactaggaccaagatacaccgtacctacggtacaacgacccgaacggaccaacccacctactactacc

SEQ ID NO: 331947 - DNA, 630 bp, Homo sapiens
  misc_feature: GZ8MTXP02GTBHV.21.81.H04.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (287)..(287): a, c, t, g, unknown or other
  misc_feature (287)..(287): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggtctttangactntgtctctgtacaacaataccaggcaaacgccccaaacncatcatttatgatgtcaataatcggcctgtagggtttctaaatcgtcttctctcggcctacctaagtcgtacggaccaaacgccgggtaccctcccgtacgaaccctaacgttctcgtcgggtctcccgaaggtctagacgtagacggtacggtctagtaatttactactcgtaccgtaggtactaattaactaactaaagtacaaagacctaaactacttaagtcgtacgttacgggaactacggggaaactaacgtactaccgtaccgtacccgttaacggaccgaaccgaaccccgaaccggaacccctaaacccctacttaccggtacccttaaccccg

SEQ ID NO: 331948 - DNA, 547 bp, Homo sapiens
  misc_feature: GZ8MTXP02IOMWU.21.81.H04.1.454.CMB.2.raw
  modified_base (359)..(359): a, c, t, g, unknown or other
  misc_feature (359)..(359): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccaggcaaacgccccaaactcatcatttatgatgtcagtaatcggccctctaggggtttctaatcgcttctctcgctcagtctggcaacncggccctcctgaccatctctgggcctccaggctgatgacgaggctgattatactgcaggtcatactacaaatcagacaaacacttaatgtcgttcgggacgtacgggtaccaaaggactacctaaccgtacctaacggtaccaacgaccccgaaacggacccaaaacccccgactacgtacctaaccc

SEQ ID NO: 331949 - DNA, 541 bp, Homo sapiens
  misc_feature: GZ8MTXP02HO5D2.21.81.H04.1.454.CMB.2.raw
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
  modified_base (527)..(527): a, c, t, g, unknown or other
  misc_feature (527)..(527): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcggtgacgttggtctttangactatgtctcctggtaccaacaatacccaggcaaacgccccaaatcatcatttangatgtcagtaatcggcctgtaggggtttctaatcgtcttctctcgctccagtctggcaacncggcctcctgaccatctctgggctccaggctggatgacgaggctgattatactgctaggtactatataacaatcaagtacaaactacttaatgtcgttcgggtactacggggtaaaccaaagtacttcacccgtcctaaggtccaacggccccaaaggcccaaaacccnctacgtacctaccg

SEQ ID NO: 331950 - DNA, 532 bp, Homo sapiens
  misc_feature: GZ8MTXP02FZ8IJ.21.81.H04.1.454.CMB.2.raw
  modified_base (241)..(241): a, c, t, g, unknown or other
  misc_feature (241)..(241): n is a, c, g, or t
  modified_base (335)..(335): a, c, t, g, unknown or other
  misc_feature (335)..(335): n is a, c, g, or t
  modified_base (362)..(362): a, c, t, g, unknown or other
  misc_feature (362)..(362): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaagcccccaaactcatcatttatgatgtcagtaatcggccctctaggggtttctaaatcgnttctctcggctccaagtctggccaacncggccctcctgacccatctctgggctcaggctgatgacgaggctgattatactgcaggtcatatacaatcgagcaaactacttagtgtcttacggggactggggaaccaaagtactacgacccgttccaggtaccaaggacccaaaggccccaaaccccatcgtactacc

SEQ ID NO: 331951 - DNA, 651 bp, Homo sapiens
  misc_feature: GZ8MTXP02H391W.21.81.H04.1.454.CMB.2.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctctgcactggaaaccngcggtgtacgttgtcttagtgactntcgtctcgtacgtaaccaacaactaccgaacggaccaaaccgaccccaaactactaactactatttagtagtatacgtacagtacgtcgtaccgtacgtacggtttactagtcgtctctcgtcgtctacgtacgtcgtacgacacgccgtcctcctacgacctacgtcgtcgtcggcctaccgacgtacgtacgtagtacgtacgtacgtacgtacgtaacgttacttacgtacgtacgtacgtacgtaataactaactaactaacgtaacgtaacgtaacgtaacgttaacgttacgttacgttacggtacggtacggtaacgtaaacgtaacgtaccgtaccgtaccgtacgtaccgtaaccgacccgaaccgaacccaacccgtaccgtaccgtacctaccg

SEQ ID NO: 331952 - DNA, 511 bp, Homo sapiens
  misc_feature: GZ8MTXP02JA3C7.21.81.H04.1.454.CMB.2.raw
  modified_base (242)..(242): a, c, t, g, unknown or other
  misc_feature (242)..(242): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
  modified_base (441)..(441): a, c, t, g, unknown or other
  misc_feature (441)..(441): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccacatacccaggcaaagcccccaaatcatcatttangatggtcagtaatcggccctcgaggggtttctaaatcgcttctctggcctcaagtctggcaacncggcctccctgaccatctctgggcttccaggctgatgacgngctgattatactgcaggtcatatacaatcagacacacttangtcttcgggacttggggaacctaggtactccgtcgtacgtcacgaaccgacggacacaccactcgtctac

SEQ ID NO: 331953 - DNA, 568 bp, Homo sapiens
  misc_feature: GZ8MTXP02HK3X5.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaataccaggcaaacgcccccaaactcatcatttatgatgtcagtaatcggccctcgtaggggtttctaatcgtcttctctggctccaagtctggcaacncggccctcctgaccactctcgtcgggcctcgaggctgatgacgaggctgtattatactgcaggtctatatacaatcagacaactacttagtcgtcgttacgggacgtacggggacctaaacgacgtacccgtaccgtaccgttaaggtaccaaccgaccccgaaacgggccccctaaaaccccaccgttccgttacctaacccg

SEQ ID NO: 331954 - DNA, 567 bp, Homo sapiens
  misc_feature: GZ8MTXP02H8M20.21.81.H04.1.454.CMB.2.raw
  modified_base (223)..(223): a, c, t, g, unknown or other
  misc_feature (223)..(223): n is a, c, g, or t
  modified_base (362)..(362): a, c, t, g, unknown or other
  misc_feature (362)..(362): n is a, c, g, or t
  modified_base (553)..(553): a, c, t, g, unknown or other
  misc_feature (553)..(553): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtcttatgactatgtctctggtaccaacaataccaggacaaacgccccaaactcatctatttatgatgtacagtaatccggccctgtagggtttctaatcgtcttctctcgctccagtctggcaacnccggcctcctcgaccatcctctcgggcctccgaggtctgagtgacggaggctagtatttagtactgctaggtctaataactaacaaatcaagacaaactacttatcgttcgttacgggacgtcgggaaccaagtactaccgtaccgtaccgttaacggccaaccgacccgtaaacggaccctaaaaccccncgttacgtaccacc

SEQ ID NO: 331955 - DNA, 557 bp, Homo sapiens
  misc_feature: GZ8MTXP02GXH4S.21.81.H04.1.454.CMB.2.raw
  modified_base (459)..(459): a, c, t, g, unknown or other
  misc_feature (459)..(459): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaacgcccccaaatcatcatttatgatgtcaagtaatccggccctcgtaggggtttactaactcgtcttctctcggctccgaagtctggccaacgccggtccctcctgaccctatcctcgtcgggtcctccgaggctagatgacggaggctagtattacttactgcaggtacattatacaancagacaactacttatcgtcgttcgggacgtaggaaccaagtactcgtaaccgtccgtacggtcaacgacccaacggtacccacccacgtcgtactccg

SEQ ID NO: 331956 - DNA, 623 bp, Homo sapiens
  misc_feature: GZ8MTXP02F8J1N.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaatacccaggacaaacgcccccaaactcatcatttangatgtacagtaatcggccctgtaggggtttctaatcgtcttctctcggcctccaagtctggaccaacgccggccctaccctcgaccctattcctcgtcgggcctaccgacggtctacgagtcgaacggacgggcttaggtatttaacgttacgtgacgtaggtactaattaactaactaaactacaagacctaaacttaacttattcgttacgttacgggtacgtacggggtaacctaaacggtactccggtaacccgttacgtaacggttaccaaccgaccccgaaacggacccctaacccacgtacgtacctaacccg

SEQ ID NO: 331957 - DNA, 507 bp, Homo sapiens
  misc_feature: GZ8MTXP02I2XKF.21.81.H04.1.454.CMB.2.raw
  modified_base (242)..(242): a, c, t, g, unknown or other
  misc_feature (242)..(242): n is a, c, g, or t
  modified_base (317)..(317): a, c, t, g, unknown or other
  misc_feature (317)..(317): n is a, c, g, or t
  modified_base (432)..(432): a, c, t, g, unknown or other
  misc_feature (432)..(432): n is a, c, g, or t
tcagtcgtcgctcgcacgaccggtgctcgatttagtagtgtagattcgcggggggtctcaggaggcagcgctctcgggatgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaagcccccaaatcatcatttatgatgtcagtaatcggccctnagggtttcaatcgcttctctgctcaagtctggcacgacggcctccctgaccatctctgggctcaggctgatgacgagctgattattactgcaggtcatactacaatcagcaaacncttatgtcttcgggactgggaccaagactcaccgtcctaggtcacgcccaacggcccaaaccccgtactcgtacc

SEQ ID NO: 331958 - DNA, 549 bp, Homo sapiens
  misc_feature: GZ8MTXP02IDFN9.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtacaacaatacccaggcaaagcccccaaactcatcatttangatntcagtaatcggccctcgaggggtttcaatcgcttctctggctcaagtctggcaacncgcctcctcgaccactctctggctcgagctgatgacgaggctgtacttatactgtctaggtctatattaacactcaagctaaactactttatcgtcgttacgggtaactacggggacaaacgtactccgtacccggtaccttaggaccaacggaccccaaacggacccccaacccgtacctcgtacctaccg

SEQ ID NO: 331959 - DNA, 540 bp, Homo sapiens
  misc_feature: GZ8MTXP02F9UFW.21.81.H04.1.454.CMB.2.raw
  modified_base (244)..(244): a, c, t, g, unknown or other
  misc_feature (244)..(244): n is a, c, g, or t
  modified_base (299)..(299): a, c, t, g, unknown or other
  misc_feature (299)..(299): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttangactatgtctcctggtaccaacatacccaggcaaacgccccaaatcatcatttangatgtcagtaatcggccctgtagggtttctaatcgcttctctcggctccaagtctggcaacnccggcctccctgaccatctcgtgggcctcgaggctagatgacgaggctaggtattatactgacaggtctaatataacaatccaagacaactacttatagtcgtacgggactacgggaccaaagactacaccgtactaggtccaagccccaaacggacccaacccgtactcgtactaccc

SEQ ID NO: 331960 - DNA, 588 bp, Homo sapiens
  misc_feature: GZ8MTXP02II83S.21.81.H04.1.454.CMB.2.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
  modified_base (470)..(470): a, c, t, g, unknown or other
  misc_feature (470)..(470): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccngcggtgacgttggtctttangactatgtctctgtaccaacataccaggcaaagcccccaaactcatcatttangatgtacagtatcggccctgagggtttcaatcgcttctctcggtcctcaagtctggtccaaccncgggtccctccctgaccctatccgttcgtcgggccttccgagggtcctaggattcggacggaggtctaggtaatttacgtactggactaggtctattacactaaatcganaactaactacgttatcgttacggttcggacgtggggaaacccaagtactaccgtaccgtaccgttacggtacaaccgacccgaaacggtaccccaaacccacgtttaccacttaaccc

SEQ ID NO: 331961 - DNA, 655 bp, Homo sapiens
  misc_feature: GZ8MTXP02JY6PQ.21.81.H04.1.454.CMB.2.raw
  modified_base (266)..(266): a, c, t, g, unknown or other
  misc_feature (266)..(266): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaanaatacccaggcaaacgcccccaaactcatcatttatgatgtacagtaatccggcccctcgtaggggtttctaaagtcgtcttctctcggcctaccaagtctggaccaacgtaccggccctccctacgaccatcctcgtcgggcctacccgaggtcctgatcggacgagggcttagtatttagttaactgaccgtaggtactattaataacctaaatcaacgactaaacctacgttaaacttgttaccggttacggggaaccgttacggggaaaccctaaacggtacctaccgtacccggttacccttaaccgggttacccgaaccggaacccccgaaacccgggaacccccgtaaaccccctaccgttaccggtaccctttaacccccg

SEQ ID NO: 331962 - DNA, 550 bp, Homo sapiens
  misc_feature: GZ8MTXP02GEKNQ.21.81.H04.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
  modified_base (448)..(448): a, c, t, g, unknown or other
  misc_feature (448)..(448): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgtttggtctttangactatgtctctggtaccaacatacccaggcaaacgccccaaatcatcatttangatgtcagtaactcggcctcgtaggggttctaatcgcttctctcggctcaagtctggacaacncggccctcctgaccatctcgtcgggctccgaggctgatgaacggngtctagtattatacgtgactaggtactataactacaatacanactaactacttagtcgtcgtacggacgtacggaactaacgtacgtaccgtaccgtaccgtacgtaccaacgacccgaaacgacccaactaccactacgtacc

SEQ ID NO: 331963 - DNA, 572 bp, Homo sapiens
  misc_feature: GZ8MTXP02HXC3T.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcggtgacgttggtctttangactatgtctctgtacaacaactaccaggacaaacgccccaaactcatctatttatgtatgtcaagtaactccggtccctacgtaggggttttacaactcgtcttctctcgcctcaagtctggaccaacgaccgccctcctcgacctatcgtctcgggcctccgacggtctgatggacgagctagtaattattactgctaggtactaattactaacatacagacaactacttatcgtacgttacgggtactacgggaccaaacgtactaccgaccgttcgtacgtcaaccgtaccaacggtaccccaaaccgtactacgtacctacccg

SEQ ID NO: 331964 - DNA, 587 bp, Homo sapiens
  misc_feature: GZ8MTXP02JJROW.21.81.H04.1.454.CMB.2.raw
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggacaaacgcccccaaactcatcatttangatgtcagtaatcggccctcgtagggtttctaatcgcttctctcggctccaagtctaggacaacgacggccctccgtagacctatcgtcgtcgggcctcgaggtcctgactggacagggctgtattatactgcagtctaatatacaaatcaagactaactacttagtcgttcgtacgggtaacgttacgggaaaccctaaaggtactaccgtaccggttaccgtaggttaccaacggtaccccgaaaacggtacccccaaaaccctcgttacggtaccctacccg

SEQ ID NO: 331965 - DNA, 532 bp, Homo sapiens
  misc_feature: GZ8MTXP02F2B5N.21.81.H04.1.454.CMB.2.raw
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
  modified_base (430)..(430): a, c, t, g, unknown or other
  misc_feature (430)..(430): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaactcatcatttatgatgtcagtaatcggccctnaggggtttctaaatcgcttctctcggctccaagtctggccaacncggcctccctgaccatctcgtgggctccgaggctgatgacgaggctgattatactgcaggtcatanacaatcagacaactacttatcgtacgttcgggacttgggaaccaagactcgaccgtacgtagtccaacgcccaaacggcccaaacccctactcgtactaccg

SEQ ID NO: 331966 - DNA, 688 bp, Homo sapiens
  misc_feature: GZ8MTXP02H7RJN.21.81.H04.1.454.CMB.2.raw
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcggtgacgttggtcttatgactatgtctctggtaacaacaactacccaggaccaaacgacccccaaactcactctatttatgtatgtacaagtaactccggtcccttacgtaggggtttctaatcgtcttctcgtcggctaccgtaagtcgtaggaccaaccgccggtccctccctacgaccctagtcctcgtcgggcctcccgaggtcctagactggaccgaggtacctgtaaatttacgttaactaggtccgtaagggttacctaattaaactaaaccgtaaattaccgaaacgtacctaaaacgtaactttacggtacggtttaccgggttaccgggtaacggtacggggaaacctaaacggtaaccttaccgtaacccgttccgtttaaggggtacccaaccggtaaccccgaaaaccggaccccctaaaccccgtacgttacggttaacccttacccg

SEQ ID NO: 331967 - DNA, 602 bp, Homo sapiens
  misc_feature: GZ8MTXP02F0GXS.21.81.H04.1.454.CMB.2.raw
  modified_base (244)..(244): a, c, t, g, unknown or other
  misc_feature (244)..(244): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccaggacaaacgacccccaaactcatacatttatgatgtacagtaatcggcctcgtacgggtttctaatcgcttctctcgctcaagtctggcaacgccggcctccctgacccattctcgtcgggcctccgaggtctagatagacgaggctagtattaattacgtgacgtaggtacaattaataaacaattaccgaaagacctaaactaactttacttacggtacgttacgggacgttacggggaacctaaacgtacttaccgtaccgttaccgtaacggtacccaacggaccccgaaacggacccccaaaccctacgtacgtaccttacccg

SEQ ID NO: 331968 - DNA, 557 bp, Homo sapiens
  misc_feature: GZ8MTXP02JYCKV.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (361)..(361): a, c, t, g, unknown or other
  misc_feature (361)..(361): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacatacccaggcaaacgccccaaatcatcatttatgatgtcagtaatcggccctcgaggggtttctaatcgcttctctcggctcaagtctggacaacnccgcctcctgaccatctcgtcgggcctccgaggctagactgacgaggctagtacttagttactgcaggtcatatacaatcagaccaaactacttatcgtacgtacggtacgtacggggaaccaaagtactaccacccgtacgtacgggtaccaaccgacccgaacggacccaaaccccgcgtacgaccttaacccg

SEQ ID NO: 331969 - DNA, 543 bp, Homo sapiens
  misc_feature: GZ8MTXP02JI2IR.21.81.H04.1.454.CMB.2.raw
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtacaacataccaggcaaagccccaaatcatcatttangatgtcagtaatcggccctgaggggtttctaatcgtcttctctcgctccaagtctggccaacnccggcctcctgacctatctcgtcgggcctccgaggctgactgacgaggctagattatactgcaggtcaatatacatcagacaaactacttagtagtcgttacgggactacggggacctaaaacgctacgaccgttacgtacggtacaacgcccaaacggacccaacccgtacgtacgtctaacccg

SEQ ID NO: 331970 - DNA, 705 bp, Homo sapiens
  misc_feature: GZ8MTXP02H3U5X.21.81.H04.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgacgttggtctttangactatgtctcctaggtaccaacaactaccaggacaaacgccccaaatcatcatttangtatgtacagtaactcggcctgtaggggtttctaatcgtcttctctcggtcctaccgagtctggaccaacnccggtccctcctacgacctatcctcgtcgggcctcccgaggtcctggacgtcggacggaggtcttaggttaacttacgttaacgtggtacgtacgggttaactaataaactaactaacgttaacaacggtaacctaaactaacgtttacgttacgggttccgttaaccggggtaacggttacgggggaaaccctaaacggtaaccgttaacccggtaaccccggttaccgtttaaacggggtaccccgtaaacccgggtaacccccgaaaacccggggtaaccccccgtaaaaccccttacccgggttacgttaaaccccgtttacccccg

SEQ ID NO: 331971 - DNA, 531 bp, Homo sapiens
  misc_feature: GZ8MTXP02HCP0R.21.81.H04.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (355)..(355): a, c, t, g, unknown or other
  misc_feature (355)..(355): n is a, c, g, or t
  modified_base (430)..(430): a, c, t, g, unknown or other
  misc_feature (430)..(430): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactntgtctctgtacaacataccaggcaaacgccccaaactcatcatttatgatgtcagtaatcgccctcgtagggtttctaatcgtcttctctcgctccagtctgcaacnccggcctcctcgaccatctcgtcgggctccgagctgatgacgaggctgtattatactgcagtctatatacatcanacaactacttatgtcgtacggactacgggaccaaacgactaccgtaccgtccgtaggtaccaacgacccgaaacggacccaaacccgtcgtctacctaccc

SEQ ID NO: 331972 - DNA, 615 bp, Homo sapiens
  misc_feature: GZ8MTXP02JS7C5.21.81.H04.1.454.CMB.2.raw
  modified_base (244)..(244): a, c, t, g, unknown or other
  misc_feature (244)..(244): n is a, c, g, or t
  modified_base (299)..(299): a, c, t, g, unknown or other
  misc_feature (299)..(299): n is a, c, g, or t
  modified_base (414)..(414): a, c, t, g, unknown or other
  misc_feature (414)..(414): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggcggtgacgttggtctttangactatgtctctggtaccaacaataccagacaaacgcccccaaatcatcatttangatgtacagtaatccggccctcgtagggtttctaatcgtcttctctcgctccaagtctggacaacgccggccctccctacgacctatctcgtcgggcctccgaggctgatgacgnggctgtattatactgcgaggtcaatataacaatcaagacaaactacttagtcgttacgttaacgggtacgttacgggaaacctaaacggtaaacttacccgtaaacccggttcccgttaaacggtaccgtaacccggtaacccccgaaaaccgggtaaccccccaaaacccccggtaccttacccggtacccttaaccccg

SEQ ID NO: 331973 - DNA, 586 bp, Homo sapiens
  misc_feature: GZ8MTXP02GSEBM.21.81.H04.1.454.CMB.2.raw
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (413)..(413): a, c, t, g, unknown or other
  misc_feature (413)..(413): n is a, c, g, or t
tcagtcgtcgctcgcacgaccggtgctcgatttagtagtgtagattcgcgggggggtctcaggaggcagcgctctctggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttangactatgtctctgtaccaanaactaccaggacaaacgccccaaactcatcatttangatgtacagtaactcggccctacgtagggtttcaatcgtcttctcctgcctacagtctcggacacgacgcctcctcgacctatctcgtcgggctaccgagctagacgtgaccggngtctagtattacttactgacacggttacaatactaacaactcaagactaaactacttacgtacgttacgttacggacgttacgggaaacctaaacgtacgttaccgtacccgtacgttaacggaaccgaccggaaccccgaacggaccccaaacccctacgttaccgtaaccc

SEQ ID NO: 331974 - DNA, 728 bp, Homo sapiens
  misc_feature: GZ8MTXP02G1BTR.21.81.H04.1.454.CMB.2.raw
  modified_base (252)..(252): a, c, t, g, unknown or other
  misc_feature (252)..(252): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtcggaaccaggcggtgtacggttggttactttangtacttatcgtctcctcggtaaccaacaactaccgaggaccaaacgaccccaaatcatactatttatgtatgtacaagtaacgtccggtacccttacggtacggggtttactaaacgttccgtctttccgtcgtccggtacctaccgtaagttccgtacgggaaccctaaaccgtacccggggtccccttacccgtaccggtaaccctaccgttccgtcggtcggggtaccctccggacggtccttagggactacgggacgtacgggtaccttaggtacttacgttacgtcggtaccgtaaggttacctaaattaacgttaacaaacgttacgaaacgtaaaccttaaacttaacgtttacgttacggttaccggttacggggtaacgtaccgggaaactaacgtacctaccgtaccgtacgtacgtacgaacccgacccgaaccggaccccaaccctacgtacgtaccttacccg

SEQ ID NO: 331975 - DNA, 625 bp, Homo sapiens
  misc_feature: GZ8MTXP02GGXWD.21.81.H04.1.454.CMB.2.raw
  modified_base (244)..(244): a, c, t, g, unknown or other
  misc_feature (244)..(244): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaataccaggacaaacgcccccaaatcatcatttatgatgtacagtaatccggccctcgtaggggtttctaatccgcttctctcggtacctcctaagtctgggaccaacgaccggtccctaccctacgaccctatcctcgtgggtcctcccgaggtctacgatggacgaggtctagtacttagttactggaccaggtactaataattaacaagtacagacaaactacttatcgttacgttacgggaacgtacggaaacccaaagtaccctaccgtacccggttaccgtaaccgggtaccaaccggtacccccgaaaacggaccccctaaaacccccgtacgtacccggtaccttaacccg

SEQ ID NO: 331976 - DNA, 578 bp, Homo sapiens
  misc_feature: GZ8MTXP02INCSC.21.81.H04.1.454.CMB.2.raw
  modified_base (244)..(244): a, c, t, g, unknown or other
  misc_feature (244)..(244): n is a, c, g, or t
  modified_base (371)..(371): a, c, t, g, unknown or other
  misc_feature (371)..(371): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttangactatgtctctgtaccaacaactaccaggacaaacgaccccaaactcatcatttatgtatgtacagtaactccggcctcgtagggtttactaagtcgtcttctctcgcctcctagtctgaccaacnccgtcctccctcgaccatctcgtcgggcctccgaggtctagatcgacgagtctagtattatactgacgtagtactaatactacaactcaagacaactacttatacgtacgttacgggtacgtacgggaacctaaacgacgtaccgtaccgtaccgtacggtaccgaaccgacccgaacggaccccaacccactaccgtactaacccg

SEQ ID NO: 331977 - DNA, 718 bp, Homo sapiens
  misc_feature: GZ8MTXP02J1IAV.21.81.H04.1.454.CMB.2.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacaggatcctgggcccagtctgccctgactcagcctgcctccgtgtctgggtctcctggacagtcgatcaccatctccngcactggaaccngcggtgacgttggtctttangactatgtctcctggtaccaacaataccaggacaaacgccccaaatcatctatttatgatgtacagtaactcggacccttgtagggtttactaacttcgtcttactcccgtcggtcctaccgtaaagtcgtacggacctaaccgaccgggtacccctccccgtacgaccctaagttcccttcggtccggggtacccttacccggacgggtccttaggacgttacggggaacggtacgggtacctttaggtaattttaacgtttaccggtacggtccggtaacgggttaccctaaagtttaactaaaccgtaagttaccaaacggtacctaaaaccttacgttttaacgtcggttacccggtttacgggaaccgggttaaccggggaacctaaaacggtcgtaacccgtacccgttacgtacggtcgaaacccggacccgaaacggtacccccaaaccctcgtacgttaaccccg

SEQ ID NO: 331978 - DNA, 643 bp, Homo sapiens
  misc_feature: GZ8MTXP02H4VGK.21.81.H04.1.454.CMB.2.raw
  modified_base (301)..(301): a, c, t, g, unknown or other
  misc_feature (301)..(301): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtcttatgactatgtctctggtaccaacaactaccaggacaaacgccccaaactcatctatttangtatgtacaagtactccggcccttcgtaggggtttactaactcgtccttctctccggcctccgaagtctcggacaacgccggcctcctcgaccatctcgtcgggcctccgaggtcctaggacgtcggaaccgtaggtacgttggtaaactttacgttacgtacgtacgtaacgggttactaattaacgtaactaaataccgaacgtacctaaactaacgtttacgtacgttacgttaccgggacgttacggggaaacctaacgtacgtaccgtaccgttccgtaacggtcgaaccggaccccgaaacggtaccccctaaaccctacgttcgtaaccttcccg

SEQ ID NO: 331979 - DNA, 649 bp, Homo sapiens
  misc_feature: GZ8MTXP02IJXG3.21.81.H04.1.454.CMB.2.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaaccaacaataccagacaaacgaccccaaactcatcatttangatgtcagtaatcggcctgtagggtttcaatcgcttctctcgctcagtcngcaacncgcctcngacctntcncgtcggctcgagctgatgacgaggtctagtatttacgtactacgtacgtaggttactaagttaacttaaaccgtaaaattacgaaacgtaaccttaaaaccttaacgttttaaacgttcgttaaccggtttaaccggggtaccgttaaaaccgggggtaaacctaaacggttaaaccgttacccgtaaacccgttaaccggttaacgtaaccgaaaccggtaaccccgtaaaaccgggtaccccctaaaaccccgtacgttaccgttactaaccccg

SEQ ID NO: 331980 - DNA, 556 bp, Homo sapiens
  misc_feature: GZ8MTXP02F0TP0.21.81.H04.1.454.CMB.2.raw
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
  modified_base (440)..(440): a, c, t, g, unknown or other
  misc_feature (440)..(440): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggacaaacgcccccaaactcatcatttangatgtcagtaatcgccctgtagggtttctaatcgcttctctcgctccaagtctggcaacgcgcctccctgaccatctcgtgggcctcgaggtctgatgaagnggtctagtattatctgcagtcatataacatacganacaaactacttagtcgttacgttacgggactacgggaacaacggtactaccgaccgtacgtacggtaccaacggaccccgaaacggacccccaaaccctacgttaccgtactaccc

SEQ ID NO: 331981 - DNA, 594 bp, Homo sapiens
  misc_feature: GZ8MTXP02FM262.21.81.H04.1.454.CMB.2.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaacgcccccaaatcatcatttangatgtacagtaatccggccctcgtaggggtttctaatcgcttctctcgctccaagtctggacaacncggcctcctagaccatctcgtgggcctccgagctgatgacgnggctagtattacttacgtgacctaggtactaagtaactaacaaattaccagtaccaaactaacttagtacgttacgtacgggtaacgttacgggaaacctaaagtactaccgtacccgttacgtacggtaccaaccggtaccccgaaacggtacccccaaccccgtacgtcggtaccttaaccccg

SEQ ID NO: 331982 - DNA, 710 bp, Homo sapiens
  misc_feature: GZ8MTXP02HBSI7.21.81.H04.1.454.CMB.2.raw
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
tcagtcgtcgctcgcacgaccggtgctcgatttagtagtgtagattcgcgggggggtctcgaggaggcagcgctctcggggacgtctccaccatggcctgggctctgctattcctcacccctcctcactcagggcacagggtcctgggcccagtctgccctgactcagcctgcctccgtgtctgggtctcctggacagtcgatcaccatcctcctgcactggaaccngcggtgacgttggtctttatgactatcgtctcctaggtaccaacaactacccaggacaaacgacccccaaactcatacatttangatgtacagtaatccggcctacgtaggggtttctactaccgtcttcgtcgtcggtcctccgtaagtcctagaacctaacgaccggtccctacccgtacgaccctattccgtcgtcgggacctccgaacggctagagtcgacggacggctaggtaattacgttactggtactaacgggtactaattaaactaactaaacttaccgaaacgtaacctaaaacttaactttaacgttacgggtttaccgttaaccgggggtaaccgtaacgggggtaaaccctaaaacggtacgttaacccgtacccggttaacccgttacggtaaccgaaaccggtaacccccggaaaaccggtaaccccctaaacccccgtaccgttaaccggtaccctttaacccccgg

SEQ ID NO: 331983 - DNA, 698 bp, Homo sapiens
  misc_feature: GZ8MTXP02HQ4C2.21.81.H04.1.454.CMB.2.raw
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaactaccaggacaaacgcccccaaactcatctatttatgtatgtcagtaatccggtccctcgtagggtttactaatccgtcttctcgtcggcctaccgtaacgtcgtacggaccaaaccgtacccggtccccttcccgttacgaaccctaccgttccgtccggttaccggggcccttacccgacggtcgtacggtacgttcggtaacggacggtccgttaggtaatttacgttaacgttggtaccgtaaagggttacctaattaaataaacctaacgtacaaacgtacctaaaacttactttaacgtcgtttaccgttacggggtaacgtaaccggggtaacctaaacggtacctaccgtaaccccgttccgtaaccggtacgaaccggacccgaaaaccggtccaaaaccgtaccgtaacctacgttaaccc

SEQ ID NO: 331984 - DNA, 585 bp, Homo sapiens
  misc_feature: GZ8MTXP02GUJBS.21.81.H04.1.454.CMB.2.raw
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
  modified_base (456)..(456): a, c, t, g, unknown or other
  misc_feature (456)..(456): n is a, c, g, or t
tcagtcgtcgctcgcacgaccggtgctcgatttagtagtgtagattcgcgggggggtctcaggaggcagcgctctcgggactctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctgtaccaacataccagacaaacgccccaaatcatcatttangatgtacagtaactcggcctcgtagggtttctaatcgtnttctctcgcctcaagtctggacaacnccgtcctcctgaccatccgtctgggcctccgaggtctagatgacgaggtctacgtaattacttactagcctaaggtcctaattaacttaaccaaaanacgaacgacctaaactacttagtacgttacgtacggtaacgtacggaaacctaaagtaccgtaccgtaccgtaccgtacgtaccaaccgtaacccgaaccgaccccaaacccgacgtacgtactaaccg

SEQ ID NO: 331985 - DNA, 528 bp, Homo sapiens
  misc_feature: GZ8MTXP02JHM8N.21.81.H04.1.454.CMB.2.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (430)..(430): a, c, t, g, unknown or other
  misc_feature (430)..(430): n is a, c, g, or t
  modified_base (518)..(518): a, c, t, g, unknown or other
  misc_feature (518)..(518): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaatcatcatttangatgtcagtaatcggccctcgaggggtttctaatcgtcttctctgctccatctgcaacncggacctcctgaccatctcnggctcaggcngatgacgaggctgtattatcgtgctagtcatatacaatcganacaactactatcgtacgttacgggactagggaccaaaggtactaccgaccgtacgtacggtacaacgaacccacggtacccaaccctntccgtactcc

SEQ ID NO: 331986 - DNA, 669 bp, Homo sapiens
  misc_feature: GZ8MTXP02H75ZP.21.81.H04.1.454.CMB.2.raw
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcggtgacgttgtcttatgactatgtctctggtaccaacaactaccaggacaaacgacccccaaatcatctatttangatgtacaagtaatcggacctagtacgggtttcaatcgtacttctctcgctaccaagtcgtaggacaacnccggtcctaccacgtacctactcgtacgtcgaccctcgaggtcctagtaacgcggtaacggtaggtcttaggaactttacttaccgtaggaccgttaaggttactaaattaacgtaacctaaagttaccaaacgtaacctaaacttaactttaaacgttcggttaccgtttaccggggtaacttaacgggggaaaccctaaaggtaacgtacccggtaacccgttacccgttaaggggtaaccaaccgggtaccccaaaacggtcccccaaaaccccgtcgttacgttaaccgtaccccg

SEQ ID NO: 331987 - DNA, 595 bp, Homo sapiens
  misc_feature: GZ8MTXP02IHC2S.21.81.H04.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (298)..(298): a, c, t, g, unknown or other
  misc_feature (298)..(298): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtcttangactatgtctctggtaccaacaactaccaggacaaacgaccccaaatcatcatttangatgacaagtatccggcctagtacgggtttacaatcgtcttctctcggctacagtctaggaccaacgccggcctcctacgacctactctcgtcgggcctccgaggtctacggatcgacgacggtctagtaattacgttacagctaggttactataactaacaattacaaagactaaacctagtttaactcggtaccgttacgggtacgtacggggtaaccaaagtaccgtaccgtaccgtaccgttaggtaccgaacgacccaaccggacccaaaacccgtctaccgtactaacccg

SEQ ID NO: 331988 - DNA, 556 bp, Homo sapiens
  misc_feature: GZ8MTXP02JFXPE.21.81.H04.1.454.CMB.2.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtnacgttggtctttangactatgtctctggtaccaacactaccaggacaaacgccccaaactcatcatttatgatgtcagtaactcggcctgagggtttctaatcgtcttctctcggtctccgaagtcgtggacaacgaccggccctcccgtgacccatctcgtgggcctccgaggctgatcgacgacggctagtattacttacgtgacgtgtactatactacaaatcagacaactattactgttctacgggtactacgggaacaaggactccgtaccgtcgtacgtacgaacgacccgacggaccccaaccgtacctagtaccctacg

SEQ ID NO: 331989 - DNA, 595 bp, Homo sapiens
  misc_feature: GZ8MTXP02HIDVD.21.81.H04.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (371)..(371): a, c, t, g, unknown or other
  misc_feature (371)..(371): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtcttangactatgtctctgtacaacaactaccagacaaacaccccaatcatctatttatagtatgtacaagtacgtcggtcctgtacggtttactaatcgtcttctctcgtctacagtctgacacgccgtcctccncgacctactctcgtcggcctcgaggtctagagtcgacgtacgtcgtagttatttacgttacgtagtacgtaaggtactaaataactaactaacgtacgaaacgtactaaactacttagtacgttaccgttacggtacgtacgggaactaaacgactaccgtaccgttacgtacggtaccaaccgtacccgaaaccgaccccaaacccgtcgtacgtacctaccg

SEQ ID NO: 331990 - DNA, 540 bp, Homo sapiens
  misc_feature: GZ8MTXP02G9IFV.21.81.H04.1.454.CMB.2.raw
  modified_base (265)..(265): a, c, t, g, unknown or other
  misc_feature (265)..(265): n is a, c, g, or t
  modified_base (334)..(334): a, c, t, g, unknown or other
  misc_feature (334)..(334): n is a, c, g, or t
  modified_base (460)..(460): a, c, t, g, unknown or other
  misc_feature (460)..(460): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactggaaccaggcggtgacgttggtctttatgactatgtctctggtaccaanaatacccaggcaaagcccccaaaatcatcatttatgatgtcagtaatcggcctcgaggggtttctaaancgtcttctctacggctaccaagtctggacaacacggcctcctgaccatctctgggcctcaggctgatgagaggctgaattatactggctaggtcaatataacaaatccatacaaactacttatgtnttcgggactgggaaccaaaggactacaccgttaacaggtacaacggacccaaagggaccccaaaccccagtacgtctacc

SEQ ID NO: 331991 - DNA, 528 bp, Homo sapiens
  misc_feature: GZ8MTXP02G18H1.21.81.H04.1.454.CMB.2.raw
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttangactatgtctcctggtaccaacaatacccaggcaaacgccccaaactcatcatttangatgtcagtaatcgcctcgaggggtttctaatcgtcttactctcggctcaatctggacaacnccggcctcctagaccatctcngggctcgagctgatgacgaggctgtattattactgctagtcatactacaatcagacaactacttagtgtactacgggactacggaacaacgtatccgtaccgtacctagtaccaagcccaacggacccaacccactcgtaccac

SEQ ID NO: 331992 - DNA, 551 bp, Homo sapiens
  misc_feature: GZ8MTXP02JG1WH.21.81.H04.1.454.CMB.2.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (370)..(370): a, c, t, g, unknown or other
  misc_feature (370)..(370): n is a, c, g, or t
tcagtcgtcgctcgcacgaccggtgctcgatttagtagtgtagattcgcggggggggtctcaggaggcagcgctctcggggacgtctccgaccatggcctgggctctgctattcctcaccctcctcactcagggcacagggtcctgggcccagtctggccctgactcagcctgcctccgtgtcctgggtctcctggacagtcgatcaccatctcctgcactggaaccngcggtnacgtttggtctttangactatgtctctggtaccaacatacccaggcaaacgccccaaactcatcatttancgatgtcagtaactcggccctgtagggtttactaactcgtcttctctcggctcagtctcggacacncggcctacctgaccatctctgggctcgaggctggatgacgagctagattatactgaccaggtcaatatacaactcacacaaactacgttatcgtcttacgggactacgggaacctaaaggactaccaccgttactagggaccaacggaacccaaacggcccaaacccactcgtcctaaccg

SEQ ID NO: 331993 - DNA, 531 bp, Homo sapiens
  misc_feature: GZ8MTXP02HXVJC.21.81.H04.1.454.CMB.2.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
  modified_base (420)..(420): a, c, t, g, unknown or other
  misc_feature (420)..(420): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcggtgacgttggtctttangactatgtctcctggtaccaacaataccaggcaaacgcccccaaatcatacatttatgatgtcagtaatcggccctntaggggtttctaagtcgtcttctctcggctccaagtctggcaacacgtcctccctgacctatctctcgggctccgaggctgatgacgaggctagattatacngcagtcatatacatnanacaactactatcgtacttcggactcgggaacaacgaacgtcaaccgtcctaaggtcaacgacccaaacggacccaaccctactacgttacaccg

SEQ ID NO: 331994 - DNA, 566 bp, Homo sapiens
  misc_feature: GZ8MTXP02HPRAI.21.81.H04.1.454.CMB.2.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (367)..(367): a, c, t, g, unknown or other
  misc_feature (367)..(367): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctcctgcactggaaccnggcggtgacgtttgtctttangactatgtctcctggtaccaacaatacccaggacaaacgcccccaaactcatctatttatgatgtcaagtaatccggccctagtaggggtttctaatcgtcttctctcgctcagtctggcaacnccggcctcctgacctatctcgtcgggcctccgaggctagatggacgaggtctaggtatttatacgtgtcctaggtactaatattacaaattcaagtacaaactacgttagtcgttccgtacgggactacgggaccaaggtactacgtacccgtcgtacggacaacgacccaacggacccaaacccgctacgtactaccg

SEQ ID NO: 331995 - DNA, 649 bp, Homo sapiens
  misc_feature: GZ8MTXP02GGHOM.21.81.H04.1.454.CMB.2.raw
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccagcggtgtacgttggtcttangactatgtctctgtaccaacaataccagacaaacgacccccaaatcaatctatttanagatgtacagtaactccggcctacgtagggtttactaatccgtcttctcgtcgtctacctaagtcgtaggaccaaccgtccgggccctcccgtacgaccctattcgtcgtcgggacccttccgaaggtcctagagttacgaaaccgtagggtaccttaggtaatttaacgttaccgtaggtaccgtaaaggttacctaaagttaacttaaaacgaacgttaaccaacgaaaccttaaactaaccgtttaatcggttaccgttacgggaacgttacgggaaactaaacggacttaccgaccgttacgtacgacaaccgacccgaaacgaccccaacctactcgtaactccg

SEQ ID NO: 331996 - DNA, 531 bp, Homo sapiens
  misc_feature: GZ8MTXP02I6C4G.21.81.H04.1.454.CMB.2.raw
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccccaggcaaacgcccccaaactcatcatttangatgtcagtaatcggccctcgtaggggtttctaatcgtcttctctgctcatctgcaacncgccctcctgaccatctcgtgggcctcgaggctgatgacgnggctgtattatactgcaggtcaatatanaatcagacaactacttatgtcgtacggtactacgggacaacgactacaccgtccgtagtacaacgacccgaacggaccccaaccctacgtctacctaccg

SEQ ID NO: 331997 - DNA, 657 bp, Homo sapiens
  misc_feature: GZ8MTXP02F0LY0.21.81.H04.1.454.CMB.2.raw
  modified_base (243)..(243): a, c, t, g, unknown or other
  misc_feature (243)..(243): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggacaaacgacccccaaatcaatcatttangatgtacagtaatccggccctacgtaggggtttctaaatccgtacttctctcggtcctaccaagtctaggaccaaacnccggccctccctagacccattcctcgtcggggtcctccgaggtcctagacttgacgacggtctagtaacttattaaccgtgacctaaggtcctaaattaactaacaaaattccaagtaacctaaactaactttagtacgtttacgttaccggtacgtacggggaaaccctaaaggtaacttaccgtaacccgtttaccgtaacgggttacccgaaaccggtacccccgaaaacggaccccccaaaacccccgtacgttacgtaacccttaaccccg

SEQ ID NO: 331998 - DNA, 582 bp, Homo sapiens
  misc_feature: GZ8MTXP02GITRU.21.81.H04.1.454.CMB.2.raw
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttaangactatgtctcctggtaccaacaataccccaggcaaaagcccccaaaactcatcatttaangatntcagtaatcgcctgtagggttctaatcgcttctctcgctacaagtctggacaactaccggcctccctacgacctatctcgtcgggctacgaggctagagtagacgaggacgtagtattaattaactacgtcgtagtactataataacaaactacagacaaactaacttaattagtacgttacggtacggtacgggaaccgaaacgtaacgtactaccgtaccgtaacgtacgaacgacccgaaaccgacccaaaccccaacctacgtacctac

SEQ ID NO: 331999 - DNA, 750 bp, Homo sapiens
  misc_feature: GZ8MTXP02G1U8N.21.81.H04.1.454.CMB.2.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (327)..(327): a, c, t, g, unknown or other
  misc_feature (327)..(327): n is a, c, g, or t
  modified_base (420)..(420): a, c, t, g, unknown or other
  misc_feature (420)..(420): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtcggaaccnggcggtgtacgtttggtactttagngtacttagtcgtcctccgtacgtaaccaaactaacgtacccgagaccaaaccgcccccaaactcatactatttangtatgtactagtacgtcgccctggttaggttctacgtctctctcgtcgtcctactagtcgtacggaccaacgccggtcctaccgtacgacctntccgtcgtcgggtccctacgtacggtccgttaggacggtacgaacggttcggtacgttattaacgtttacgttaacgtcggtaaccgttacggtacttaaagtaacgttaacctaaaagttaccaaacgttaacctaaaacgttttccgtttaagttaccgggtttaccgggttaaccggggtaaccggttaaaacccggggaaactttaaccggtaacccgttacccgttaacccggttaccgtaaacccggtaccgaaccccggtaaacccgaaaaccggtaacccccccttaccggttaacctttaccccggtcctttaacccccgg

SEQ ID NO: 332000 - DNA, 631 bp, Homo sapiens
  misc_feature: GZ8MTXP02HATYR.21.81.H04.1.454.CMB.2.raw
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (421)..(421): a, c, t, g, unknown or other
  misc_feature (421)..(421): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctctgcactggaaccagcgtgacgttgtcttatgactatgtctctagtacaacaactaccagcaaacgccccaaatcatcatttangatgtacagtaacncggtcctcgtagggtttctactctcttctctacgctacaagtctacggactaacnccggtcctccgtacgtacctatccgtgtcgggtcctcgaggtctgacgtcgaacgggngtacttagtaacttacgtacgtacgtacgtaaacgtactaaataacttaacaactacgaaacgtaactaaacttacgttacgtacgttaccggtacgggtaacgtaccggaaaccgtaacgtaaccgtacccgtaaccgtaccgtaaccggtaacccgaacccggtaacccgaaaccgtacccctaaacccgtacgttacctacctaccg

SEQ ID NO: 332001 - DNA, 544 bp, Homo sapiens
  misc_feature: GZ8MTXP02F8GNF.21.81.H04.1.454.CMB.2.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggcaaagcccccaaatcatcatttangatgtcagtatcggcctgagggtttctaatcgcttctctcggctcaagtctggacaacgccggcctccctgaccatcnctgggctccaggctgatgacgaggtctagtattattactgacaggtacagtataacaatacagacaactacttaagtgtcttacgggactaggggaaccaagtactcgaccgttaccgtacgttacaacgacccaaacggaccccaaaccccactacgtacctaccg

SEQ ID NO: 332002 - DNA, 566 bp, Homo sapiens
  misc_feature: GZ8MTXP02JWNMP.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaatacccaggacaaacgcccccaaactcatcatttatgatgtcagtaatcggccctgtacggggtttctaatcgtcttctctcggtctacctaagtctggacaacncggcctccctgacctatctcgtgggcctcgagctgatgacgngctagattatcagcaggtcataatacaatcaagacaaactacttagtagtcgtacgggtacgttacgggaaccaacggtactccgtaaccgtccgttaacggaccaacggaccccgaaacggacccccaaaaccctccgttacgtacctacccg

SEQ ID NO: 332003 - DNA, 532 bp, Homo sapiens
  misc_feature: GZ8MTXP02G9MA8.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaataccaggacaaagcccccaaatcatcatttangatgtcagtaatcggcctcgaggggtttctaatcgtcttctctcggctaccaagtctggcaacncggcctcctgaccatcnctgggctcgaggctgatgacgagctgattatacngcaggtcatatacaatcagactaacattatagtcgtcgggactcgggaccaagtactccaccgtacctaggttaccaacgtacccgaaacggacccaaccccgtactcggacctaaccg

SEQ ID NO: 332004 - DNA, 577 bp, Homo sapiens
  misc_feature: GZ8MTXP02HCQP8.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (371)..(371): a, c, t, g, unknown or other
  misc_feature (371)..(371): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaaccaacaactacccaggacaaaacgccccaaactcatcatttatgatgtacaagtaactccggcctacgtagggtttctaatcgtcttctcgtcgctcagtctgacaacncgtcctcctcgacatctcgtcgggcctcgacgctagagtcgacgcgtctagtatttactacgtgacgtaggactaataactaacaatacaacgactaaacgtacttagttacgtcgtacggtacgtacggaactaacgtacgtaccgaccgttacgtacgtacgaaccgacccgaacggacccctaaccacggtactacttacccg

SEQ ID NO: 332005 - DNA, 574 bp, Homo sapiens
  misc_feature: GZ8MTXP02JWDJT.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
  modified_base (416)..(416): a, c, t, g, unknown or other
  misc_feature (416)..(416): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctcctggtaccaacaactacccaggacaaacgcccccaaactcatcatttangatgtacagtaatcggcctcgtagggtttactaagtcgtcttctctcgctcctagtctggcaacgccggccctccctcgacctatctcgtcgggcctccgagctgatgacgnggctagtattactacgtgctaggtcaattaactacaatacaacgtaccaaactacttaagtcgttacggtacgggtacgtacgggtaacaacgtactaccgtacccgtacgttacggacaacgacccgaacggacccaacccgactacgtactacccg

SEQ ID NO: 332006 - DNA, 532 bp, Homo sapiens
  misc_feature: GZ8MTXP02GUAVZ.21.81.H04.1.454.CMB.2.raw
  modified_base (304)..(304): a, c, t, g, unknown or other
  misc_feature (304)..(304): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctctggtaccaacaatacccaggacaaacgccccaaactcatcatttatgatntactagtaatcggcctgtaggggtttctaaactcgtcttctctggcctcaagtctaggacaacgccggcctacctcgacctatctcgtcgggctccgaggctgatgacgtagctagattatacngtcgagtacatatacaatcanacaactatntgtcgttacggacgtggacaagactcacgtacctagtcgaacgtaccgaacgtaccccaaccactcgtactacc

SEQ ID NO: 332007 - DNA, 563 bp, Homo sapiens
  misc_feature: GZ8MTXP02JJHSI.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcaatcaccatctcctgcactggaaccngcggtgacgttggtctttangactatgtctctgtaccaacactaccagacaaacgccccaaactcatacatttatgatgtcaagtaactcggcctacgtacggggtttactaagtcgtcttctcgtcgtcctactaagtcgtaggacaacgccgtcctcccgtacgaccactcgtcgtcgggctccgagtctagatcgagacgctgtattatactgacgtagtctataatactaatcgaatacgaactattagtacgtcgttacgggacgtacggaactaacgattaccgaccgtacgtacgtacaacgaccgaacgaccctaaaccgctcgacttaccg

SEQ ID NO: 332008 - DNA, 730 bp, Homo sapiens
  misc_feature: GZ8MTXP02G59A2.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggcggtgtacgtttggttctttagtgactatgtctccgtggtaccaacaactacccaggacaaacgacccccaaactcatactatttatgatgtacagtaactccggccctacgttacggggtttactaacgtccgtcttcttcgtcggtcctaccgtaacgtcgtcggaccaaccgtcccgggtcccttcccgtcgaaccctacttctccggtccgggtccctacccgtcggtaccgtggtaacgttacgggaacggtacgggtaccttaaggttaactttaacgttaccgtaggtacccgttaagggttaccttaaattaacgtaaactaacctaacgaacgtaccctaaacgtaaactttgtaccggtttcggtttaaccgggtaacgttaccgggggaaacctaaacggtaaccgttacccgtacccggttccgtaacggttaccgaaccggtaaccccgaaccggtaaaccccaacccccgtactaccggtaccctacccg

SEQ ID NO: 332009 - DNA, 543 bp, Homo sapiens
  misc_feature: GZ8MTXP02F1IDN.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
  modified_base (430)..(430): a, c, t, g, unknown or other
  misc_feature (430)..(430): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaataccaggcaaacgccccaaatcatcatttangatgtcagtaatccggcctgtaggggtttctaatcgtcttctctcgctccaagtctggcaacgcggccncctgaccatctcngggctcgagctgatgagngctagtattatctgcagtcatataacaatcganacaactagttatcgtcgttacgggacttacgggaaccaacggtataccgtaccgtaccgtacggtaccgaacgaccccgaaacggacccccaacccgtactcgtacctacccg

SEQ ID NO: 332010 - DNA, 584 bp, Homo sapiens
  misc_feature: GZ8MTXP02IVQRY.21.81.H04.1.454.CMB.2.raw
  modified_base (242)..(242): a, c, t, g, unknown or other
  misc_feature (242)..(242): n is a, c, g, or t
  modified_base (301)..(301): a, c, t, g, unknown or other
  misc_feature (301)..(301): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcggtgacgttggtctttangactatcgtctcctggtaccaacaatacccaggcaaacgcccccaaactcatcatttangatgtacagtaactcggccctcgtaggggtttctaactcgtctttctcgtcgtctacctaagtctggaccaacgccggccctccctcgaccctatctcgtcgggcctccgaggtctgatggaccgaggcttagtattacttacgtgacgtaggtcaatatacaatcagactaaactacttagtcgttcgttacggggacttaggggaacccaaaggactaccgaccgtaccgtacggtaccaacgaccccgaaacggaccccaacccgacttacgacctaccg

SEQ ID NO: 332011 - DNA, 654 bp, Homo sapiens
  misc_feature: GZ8MTXP02IA6DK.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccngcggtgacgttggtctttangactatgttctcctggtaccaacaatacccaggcaaagcccccaaatcatcatttatgatntcagtaactcgcctgacggggtttntaatcgtcttctcncggccccaagtctggacaacgacggcccttccgtgaccatcctcgtcgggtccctacccgaggccttagacgtacggaacgtacggggacctttaggtaatttaaactttacgttcgacgtaacggttactaaattaactaaactaaacttacgtaagacccaaaacttacttaacgttcgttacggtttaccgggaacgttacggggaaaccaacggtaaacttccgtaaccgttaccgttacggttaaccaccggtaaccccgaaacggacccccaaaacccctcgtacccgtacgtaacctttccccgg

SEQ ID NO: 332012 - DNA, 632 bp, Homo sapiens
  misc_feature: GZ8MTXP02JF9R4.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcggtgacgttggtctttangactntgtctctcgtaccaacactaccgagacaaaccgaccccaaactcactactatttatgtatgtactaagtacgtccggtacccttacggtagggtttactaacgtccgtcttctcgtccgtacctaccgtagtcgtacggaccaaccgccggtcctacccgtacgacctacttctcgtcggtcctccgaggtctaggagtcggacggacggtacttaggtaactttacgtacgtgtacgtacggttactaataactaactaatacaacgtaactaaactactttagtcgtacggttacgggacgtacgggaacctacgtactacgtaccgtaccgtacggacaaccgacccgaaaccggaccccaaccctacgtacgtacctacg

SEQ ID NO: 332013 - DNA, 604 bp, Homo sapiens
  misc_feature: GZ8MTXP02GZ0RM.21.81.H04.1.454.CMB.2.raw
  modified_base (241)..(241): a, c, t, g, unknown or other
  misc_feature (241)..(241): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttgtcttangactatgtctcctggtaccaacaactacccaggcaaacgcccccaaactcatcatttatgatgtcagtaatcggcctcgtaggggtttctaatcgtcttctctcggtctccgagtctggaccaacgccggtccctcccgtcgaccctatctcgtcgggcctccgaggtctgagtgacgaggtctagtatttactacgtgcgtaggtactaatactacaatacgaagactaactacttatcggtacgttacggggtactacggggacctaaacggtacttaccgaccgttaccgtaacggtaccgaaccggaccccgtaaaccgggacccctaaaaccccgtcgttaccgtaaccgtttacccg

SEQ ID NO: 332014 - DNA, 518 bp, Homo sapiens
  misc_feature: GZ8MTXP02F0611.21.81.H04.1.454.CMB.2.raw
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcacatctcctgcactggaaccagcggtgacgttggtctttangactatgtctctggtaccaacaataccagcaaagccccaaatcatcatttangatgtcagtaatcggccctnagggtttctaatcgcttctctggctccaagtctggcaacncgcctccctgaccntctntcgggctccaggctgatgacgngntgtattatangnagtcatanacancanacaactattatcgtcgtcggacgtcggaaacaacgtactccgaccgtacgtagaccaacgacccgaaacgaccccaacccgtactacgtactaccg

SEQ ID NO: 332015 - DNA, 616 bp, Homo sapiens
  misc_feature: GZ8MTXP02H8EJ6.21.81.H04.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaataccagacaaacgccccaaatcatctatttatgatgtacaagtaactcggtccctgtagggtttactaagtcgtcttcgtctcggcctaccgtaacgtcgtacggacctaacgaccggtcccttaccccgtacgaccctattcctcgtcgggacctccgaggtctgacgtcgacgaggcttagtaatttacttacgtagtaccgtaggtactaaataacttaacaatacacgtaaccaaacttacttaattcgtacgttaccgggaacttacgggaaccaaagtactaccgtaccgttaccgtaacgtcaaccgacccgaaacggaccccaaacccactacgtactaccc

SEQ ID NO: 332016 - DNA, 782 bp, Homo sapiens
  misc_feature: GZ8MTXP02I7H3C.21.81.H04.1.454.CMB.2.raw
  modified_base (223)..(223): a, c, t, g, unknown or other
  misc_feature (223)..(223): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccnggcggtgacgttggtctttatgactatcgtctcctggtaccaacatacccagacaaacgcccccaaactcatacatttatgatgtcagtaatcggtccctacgtaggggtttactaacgttcgtccttctcctcggtccttaccgtaaacgttccgttacgggacccaaaccgtacccggggtacccccttcccccgtacggaacccctaacttccgtttccgttcgggggtacccttacccggaacgggggtcccttaggtaaacgttcgggaaacccggtcggggtaccgtttaggttaaactttaaacgtttaccgttacgggtacccgtaagggttactaaacgttaaacttaaaccgtaaaacttaccgaaacgtaaccctaaaaccttaacgtttaacgttacgtttacccggtttacgggggtaaccgttacgggggaaacctaaacgggtaccttacccgtaacccgttacccgtaacgggttacccaaccggaacccccgtaaaccgggaccccctaaaccccgtaccgtaccggtacccgttaaccccg

SEQ ID NO: 332017 - DNA, 662 bp, Homo sapiens
  misc_feature: GZ8MTXP02GQX3U.21.81.H04.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgtacgttggtcttangactatgtctctgtacaacataccagacaaacgccccaaatcatctatttanagtatgtacaagtactccgcctacgtagggtttactaacgtcgtcttctcgtcgcctaccaagtctggaccaacgccggtccctcccgtacgaccctacgtctcgtcgggtaccttaccgacggtctaggacgttaggaaccgtacgggtacttaggttaactttacgttacgttacgaccgtaaggtacctaaattaaactaactaagtaccaagtacctaaaactaactttacgtacgttaccggttacgggacgtacggggtaaacctaaacgtacgtaccgtaaccggttaccgtaagggtacccaaaccggaaccccgaaaacggtacccccaaaacccgtctaaccggtcttaaccccg

SEQ ID NO: 332018 - DNA, 542 bp, Homo sapiens
  misc_feature: GZ8MTXP02FHRFA.21.81.H04.1.454.CMB.2.raw
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
  modified_base (531)..(531): a, c, t, g, unknown or other
  misc_feature (531)..(531): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaacgcccccaaacncatcatttatgatgtcagtaatccggccctcgtaggggtttctaaagtcgcttctctcggcttaccgaagtctggaccaacgccggccctccctcgaccactctacgtgggctcccgaggctgatgacgaggctgtattatctgcgaggtcatataacaatcagacaaactacttatagtcgttacgggactagggaccaaagctacaccgtcaggcaacgtaccgaacgacccaacccnctacgctaacc

SEQ ID NO: 332019 - DNA, 677 bp, Homo sapiens
  misc_feature: GZ8MTXP02H57EJ.21.81.H04.1.454.CMB.2.raw
  modified_base (327)..(327): a, c, t, g, unknown or other
  misc_feature (327)..(327): n is a, c, g, or t
  modified_base (663)..(663): a, c, t, g, unknown or other
  misc_feature (663)..(663): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatcctcctgcactggaaccaggcggtagtacggttggttactttagtgtactatgtctccgtaggtaaccaaacaactacccgaggaaccaaaaccgaccccaaactcaatactaatttangtatagtacaagtaactccggaccttacggtagggtttactaagtccgtacttctcgtcgacctaccgtaagtcgtacggacctaaccgaccggtccctaccctacgtacccaacgttccgtccgtcgggtaccctacccggaaggtccctaggtacgtacggaaccgggtagtccgttaagtaacgtttacttaacgtgtaccgtaaggtactaataaacttaacaacgtacacgaaaccaaaccttacttaagtcgtaccggttacggtacggtacgaaaccaagtactaccgtaccgtacgtacgacgaaccgacccgaaacgaccccaaccnctacgtactacccg

SEQ ID NO: 332020 - DNA, 681 bp, Homo sapiens
  misc_feature: GZ8MTXP02FTNWO.21.81.H04.1.454.CMB.2.raw
  modified_base (243)..(243): a, c, t, g, unknown or other
  misc_feature (243)..(243): n is a, c, g, or t
  modified_base (378)..(378): a, c, t, g, unknown or other
  misc_feature (378)..(378): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggacaaaacgcccccaaaactcaatacatttatgatgtacagtaatcggcctcgaggggtttctaaatcgcttctctcggtctaccgaagtcgtaggaccaaacnccgggcctccctgacccagttcctcgtcggggtaccttacccgagggtcctaggacgttacggaacggtagggtctaggtaatttaactttaccgtaggaccgaagggttaccaaagttaactaaaccaaagttacccaaacggtaccaaaaccgttaactttaagtacgtttaccgttaccgggggtaacttaccgggggaaaaccaaaggtacctaccgtaaccccgggttcttaaaccgggtccaaaccggaccccgaaaacggacccccaaaacccctaacgttcggttacctaacccg

SEQ ID NO: 332021 - DNA, 589 bp, Homo sapiens
  misc_feature: GZ8MTXP02HFC87.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (445)..(445): a, c, t, g, unknown or other
  misc_feature (445)..(445): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatcgtctcctggtaccaacaactacccaggacaaacgcccccaaactcatctatttangatgtcagtaatcggccctgtaggggtttctaatcgtcttctctccggccccaagtctaggcaacacggcctccctgaccatctcgtgggtcctccgagtcctgagtgaacgagctgtaattatactgacaggtcattanactaatacaagacaaactactttagtcgttacgttcgggaacgttacggggaacctaaggtactaccgaaccgttaccgtacgggtaccaacgaaccccgaaacggacccctaaaccccgactaccgtacctacctttaccccg

SEQ ID NO: 332022 - DNA, 774 bp, Homo sapiens
  misc_feature: GZ8MTXP02HN4IQ.21.81.H04.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccagcggtnacgttggtcttangactatgtctcctaggtaccaacaactacccaggccaaaacgcccccaaactcatacatttactgtatgtacaagtaactccggtcctcgtaggggttttactaaagtccgtacttctacgtcggtaccttaccgtaaagtccgttagggaaccaaaccgtacccgggtcccctttaccccctacggtaaccccctaaagttcccgttacccgggtttccgggggaccctttacccggaaacggtcgtttaccgaaggttaccggaaacgggtaccggtaccgttaggttaaactttacgttttaaacccggtacggtaccgtagttaactaattaaacgtaaactaataaccgaaacgtaactaaacgttaacgttagttacgtttaccgggtaacggggttaaccggtaacggtaaaaccgtaaacgtaccgttaccccgttaacccgtaccggttaaccggtaacccgaacccggtaaccccgaaaacccggaaccccctaaccccgtaccgttacccgtaccgtacccg

SEQ ID NO: 332023 - DNA, 573 bp, Homo sapiens
  misc_feature: GZ8MTXP02JUNDK.21.81.H04.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (465)..(465): a, c, t, g, unknown or other
  misc_feature (465)..(465): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcactggaaccnggcggtgacgttgtctttangactatcgtctcctaggtaccaacaactacccaggacaaacgccccaaactcatacatttangtatgtanaagtactcggtcctcgtagggttactagtcgtctctcgtcgtctacagtctgaccacncgcctcacgactntctcgtcgggcctcgagtctagataggacgtaggtctagtaattacttaacgtggactaggtactataatacatacaanacaaacttctatcgtcgtaccggtacgtacggaccaacggtactaccgtccgtaacgttacgaccgaaccgaacccgaaccggaccccaaaccgtcttaccacctacc

SEQ ID NO: 332024 - DNA, 685 bp, Homo sapiens
  misc_feature: GZ8MTXP02GAKM1.21.81.H04.1.454.CMB.2.raw
  modified_base (318)..(318): a, c, t, g, unknown or other
  misc_feature (318)..(318): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactcggaacaggcggtgtacgttggtctttatgtactatcgtctccgtaggtaaccaaacaactacccgaggaccaaaccgaccccctaaactcatactatttangtatgtactaagttaacgttcggccccttgtaaggggtttactaacgtccgttcttcctacgtcgtacctaccgtaagtcgtacggacccaacgcccgggtccctacccgtacgaccctacgtcctacggtcgggtaccttccgaacgggtctaggatcggacgcggtactagttaacttagtactggactaggtactatactaataacgtacaatactaaaccttaacgtttagttaccgttacggtttaaccgggacggttacgggaaaccctaaaggtaccgtcccgttaacccgtacgtaacggtacccaaccggaacccccgaacggtaaccccccaaccgttacggtacctaccttacccg

SEQ ID NO: 332025 - DNA, 568 bp, Homo sapiens
  misc_feature: GZ8MTXP02I83SB.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaactacccaggacaaacgcccccaaatcatcatttangtatgtcaagtactcgggccctcgtagggtttactaacgtcgtcttctcgtcgctacagtctagacaacnccggcctacctcgacctntctacgtggacctcgagctgatgtacgaggtctagtaacttagtactgatacggtactaatacgtaacaatcaagtacaactacgttatcgtacgtacgggtactacggaacctaagtactaccgtaccgtcttacggacaaccgaccgaacggacccaacccgtctacgtactacccg

SEQ ID NO: 332026 - DNA, 597 bp, Homo sapiens
  misc_feature: GZ8MTXP02IYGFJ.21.81.H04.1.454.CMB.2.raw
  modified_base (243)..(243): a, c, t, g, unknown or other
  misc_feature (243)..(243): n is a, c, g, or t
  modified_base (304)..(304): a, c, t, g, unknown or other
  misc_feature (304)..(304): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatcgtctcctggtaccaacaatacccaggacaaacgcccccaaaatcatctatttangtatgtacaagtaactccggcccttacgtaggggtttctaactcgtcttctctcggctccgaagtctagacaaccgcggtcctcctcgaccatctcgtcgggctccgacggtctaggatcggaacgcggtactagtaacttacttacgtggacttacgggtactattataactaaactcaaacggactaaactaacttagttcggtcgttacggggtaacctaggggaacctaacggactccgtaccgtacgtacggtcaacgacccgaacgaccctaaccacgtcgaactcc

SEQ ID NO: 332027 - DNA, 667 bp, Homo sapiens
  misc_feature: GZ8MTXP02FMKIO.21.81.H04.1.454.CMB.2.raw
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctgtaccaacaataccaggacaaacgcccccaaactcatcatttangtatgtcagtaactccggcctgtagggtttctaatcgcttctctcgctccaagtctggacaacgccggtccctaccctgaacctatctcgtcgggtcctccgaggctagacgtggaacgacgggtactagtaactttaacgttacgtaggtaccgtaagggtaacctaattaattaaaccctaaaattacccgaaacggtaaacctaaaacctttaacggtttaccttaagtttcccgggtttaaccgggtaaccggtttacgggggaaacctaaacggtaactacccggtaacccggttaccgtaacgggttaccaacggtaccccgaaaccggaccccaaccccgtaactccgtacttaccccg

SEQ ID NO: 332028 - DNA, 630 bp, Homo sapiens
  misc_feature: GZ8MTXP02HTDYK.21.81.H04.1.454.CMB.2.raw
  modified_base (242)..(242): a, c, t, g, unknown or other
  misc_feature (242)..(242): n is a, c, g, or t
  modified_base (301)..(301): a, c, t, g, unknown or other
  misc_feature (301)..(301): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcggtgacgttggtctttangactatgtctcctggtaccaacaactaccaggacaaacgccccaaatcatactatttangtatgtacaagtaactcggccctagtaggggtttctaaatcgtccttctcgtcggctaccaagtctggaccaacgccggtcctcccgtcgacctatcgtcgtcgggcctcccgaggctagagtgacgacggtctagtaaatttattaaccgtgaccgtaagggttactaattaacttaacaaattcgaacaaccaaactacttaagttcgttaccgtttacgggacgttacggggaaacccaaaggtactaccgtaacccgtccgttagggaaccaacggaacccccgaaacggacccccaaaacccctacgtacgttaacccctaccg

SEQ ID NO: 332029 - DNA, 579 bp, Homo sapiens
  misc_feature: GZ8MTXP02JT07C.21.81.H04.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (469)..(469): a, c, t, g, unknown or other
  misc_feature (469)..(469): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcggtgacgttggtctttagngtacttatgtctcctggtacctaacaatacccaggacaaacgcccccaaactcatacatttatgatgtcaagtaatccggtcctagtacggggtttactaatccgtccttctctcggctaccgtaagtctggacaacaccgggcctcctcgaccatctcgtcgggctccgaggctgatgacgaggctgattatactgactaggtactaatactaacatacaanctaaatacttatcgtacgtacgggacgtacgggaacaacggtactaccgaccgtaccgtagtaccgaaccgacccgtaaccggaccccaaccaccgtacgtacctacccg

SEQ ID NO: 332030 - DNA, 568 bp, Homo sapiens
  misc_feature: GZ8MTXP02IOGXR.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaacaactaccaggcaaacgcccccaaactcatcatttatgatgtcagtaatcggccctacgtaggggtttactaaatcgtcttctctggtcctccagtctggacaacaccggcctccctgaccatctctgggctccgaggctnatgagagctgattatactcgnacggtctatatactaanacagactaaactacttaatcgttcgtacgggtacgttacggggaccaacgtactaccgtacccgtaccgtacggttaccgaacgaccccaaacggacccctaaccccgactacgtaccttaacccg

SEQ ID NO: 332031 - DNA, 573 bp, Homo sapiens
  misc_feature: GZ8MTXP02HNEXM.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactntgtctctgtaccaacatacccaggacaaacgccccaaactcatacatttatgatgtcagtaatccggccctacgaggggtttctaatcgcttctctcggctcagtctgcacncgcctcngaccatctctgggctcgagcngagtgacgagctagtatattacgtgctaggtctaattatactaagtcgaagaccaaactacttattcggtacgttaccggggtacttacgggacccgtaaagaccgtacctaccccggttaccgtacggtaccgaacgaccccgaaaacggtcccccaaaacccggtacctactacccgtaaccg

SEQ ID NO: 332032 - DNA, 620 bp, Homo sapiens
  misc_feature: GZ8MTXP02G9E6V.21.81.H04.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
  modified_base (418)..(418): a, c, t, g, unknown or other
  misc_feature (418)..(418): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcggtgacgttgtcttangactntgtctcngtacacanaccagcaacgcccaaatcatcatttngtatgtcaagtaactcggcccttcgtagggtttactaatccgtcttcgtctcggactaccgaagtctcggacaacgccggtccctccgtacacctatcctcgtcgggcctccgaggtctaggatggaacgnggtacttgtaacttagttactgtaccgtaggttacctataaacttactaaataccgaagtaacctaaacttaacgttacttacggtttacgtttaccggggaacgttacggggaaacctaaacgtaccgtactaaccgtaccgttaaggtaccaaccggaccccgaaacggacccctaacccgaactttccgaactttcccg

SEQ ID NO: 332033 - DNA, 722 bp, Homo sapiens
  misc_feature: GZ8MTXP02F7WBX.21.81.H04.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcggtgacgttggtctttangactatgtctctggtaccaacaactaccaggcaaacgacccccaaactcatctatttatgatgtacaagtaactccggacctacgtaggggtttactaactcgtcttctcgtcggtcctaccgtaagtcgtggaccaacgaccgggtccctacccgtagaaccctattccgtcgtcggggacccttacccgaacgggtcctaggacgttacgacggtacggtattaacggttaatttacgttacgtacggaccgtaacgggttaacctaattaaccttaaaacaaacttaacccgaagtaacctaaaacttaacgtttaagtaccggtttaccgttaaccgggtaacggttaaccgggaaacctaaaagtaccgttaaccgtacccgttaaccggtacggttaaacccgaaccggaaacccccgtaaaccgggtaaaccccctaaaacccccgtacgttaccgtaaccctttaaccccg

SEQ ID NO: 332034 - DNA, 708 bp, Homo sapiens
  misc_feature: GZ8MTXP02ITA27.21.81.H04.1.454.CMB.2.raw
  modified_base (227)..(227): a, c, t, g, unknown or other
  misc_feature (227)..(227): n is a, c, g, or t
  modified_base (331)..(331): a, c, t, g, unknown or other
  misc_feature (331)..(331): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtcgtgggtctcctggacagtcgatcaccatctctgacacgtacggaaccnggcggtagtacggttggttactttagtcgtacttatcgtcctccgtaggtaaccaaactaactaacccgaggaccaaacccgacccccaaatcatactatttangatgtactaagtaactcggaccctaggttaggttactaactcgtctctacgtcgtctacgagtctcggaccaacgtccgtcctacccgtacgacctacgttccgtcggtcggtaccctaccggtacgtccgtaaggtaacgtcgggaaacggttaacgtccgttaagttaactttaaacgtttcgtacgtaaccgtaaggttacttaattaaaccggtaactaaacgtaaccgaacgtaacctaaacgttacggttacgttacggttaccggtaacggtacgtaacgggaacctaaagtaccgttaccgaaccgttacgtaccgtacaaccggacccgtaaaacgccccctaaaactcgttaccgtcttaaaccccg

SEQ ID NO: 332035 - DNA, 772 bp, Homo sapiens
  misc_feature: GZ8MTXP02GZBM4.21.81.H04.1.454.CMB.2.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacngtcgatcacatctctgcacgtggaaccngtcggtgtacgttgtcttangtactntcgtctctgtaccaacactaccgagacaaacgaccccaactcatctatttactgtatgtactaacgtaacgtccggtacccttacggttacggggtttactaacgttcgtctttcctcgtccggtaccgtaccgaagttccgtacggtaaccaaccgtcccgggtccccttcccgtacgtacccgtacttccgttcgtcgggtaccctccggacggtcgttagagtacggaacggtacggtacgttagttaacttaacgttaccgttaggtaccgttaaaggttaccttaattaaccgtaacgtaaactaccgtaaacgtaccttaaaaccggttacttttaacggttaccgggtttaccgggttaaaccgggtaaccgggttaaacgggaaaccttaaaaccgggtaccgttaaaccccggttacccggttaacccggtacgggttaacccgaacccggaaaccccggttaacccggtaaaccccccggaacccttacgttacccgtacccgtttaacccccg

SEQ ID NO: 332036 - DNA, 697 bp, Homo sapiens
  misc_feature: GZ8MTXP02GBZJ7.21.81.H04.1.454.CMB.2.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctgtaccaacatacccaggacaaacgcccccaaactcatcatttangatgtacagtaactccggccctcgtaggggtttactaagtccgtcttctcgtcggtcctaccgaagtctaggaccaacgccggtccctccctacgaccctatctccgtcgggccttaccgaggtctaggacgtacggaacgcgggtacttaggtactttaacgttaccgtaggtacgtacgggttacctaattaaactaaacctaaacgttacctaaaccggaacttaaaacccgttaactttacgttacggttaccgggtttaaccggggtaaccgttacggggaaaacctaaacggtaacttacccgtaaaccccggttccgtaaacggtacccgaaacccgtaccccgaaaaccggacccccctaaaaccctcgttaccggtaccctttaacccg

SEQ ID NO: 332037 - DNA, 602 bp, Homo sapiens
  misc_feature: GZ8MTXP02G14FP.21.81.H04.1.454.CMB.2.raw
  modified_base (366)..(366): a, c, t, g, unknown or other
  misc_feature (366)..(366): n is a, c, g, or t
  modified_base (419)..(419): a, c, t, g, unknown or other
  misc_feature (419)..(419): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaataccaggacaaacgccccaaactcatactatttatgatgtacagtaatcggtcctcgtagggttctaagtcgtactctctcgctccatcgtgacaacnccggcctcctacgacctatctcgtcgggtcctccgagtctacggatcggacgnggtctagtacttagttcctagtctaggtcaagtaactaataactacaacgactaaactacttaagtcgttacgttacgggaacggtacggaaccgtaaacgaccgttaccgtaacccgttaccgtacggtaccgaaccgaccccgaaaccgaccccaaaccccacgtaccgtaccttaacccg

SEQ ID NO: 332038 - DNA, 612 bp, Homo sapiens
  misc_feature: GZ8MTXP02IQKU7.21.81.H04.1.454.CMB.2.raw
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
  modified_base (460)..(460): a, c, t, g, unknown or other
  misc_feature (460)..(460): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcacntctctgcactgaaccagcggtgacgttgtcttangatatgtctctcgtaccaanactaccgagacaacgaccccaatcatactatttangtatgtactaagtacgtccggtcctacgtagggtttacctaagtcgtcttctcgtcgacctacgaatcgtaggaccaacgccggtcccctactacgaccctacttccgtcgtcgggccctaccgagtccgtgatacggtcgaaggtctagttacttagttaacgngacgtggtaaccttataactaagtaactaccgataacaacttactaacgttcgttacggtacgaccggttaggaaccctaaagtcgtaccctacggtaccgtaacgtcgaacccgaaccgaaccaaccccgaaacctctaccgtactacccg

SEQ ID NO: 332039 - DNA, 667 bp, Homo sapiens
  misc_feature: GZ8MTXP02JN79M.21.81.H04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (297)..(298): a, c, t, g, unknown or other
  misc_feature (297)..(298): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtctttangactatgtctctggtaccaacatacccaggcaaacgccccaaatcatcatttannatgtacagtaactcgcctcgtacgggtttactactccgtcttctcgtcggtcctactacgtcgtgaccaacgccggtaccctccctacgaccctatcctacgtcgggccctaccgacggtctaggactcggacggtagtccttagtaacttacttacgtacgacgttacggtactaagttaactaacgtaaactccgaacggtaacctaaccgttaacgtttagttaccggtttcccggttaacggggtaaccgtacggggtaaacctaaacggtacctaccggtacccgtaccgttaacggtacccaaccgggaccccgaaacccggtacccccgtaaaccctaccgttaaccggtacctttaccccg

SEQ ID NO: 332040 - DNA, 693 bp, Homo sapiens
  misc_feature: GZ8MTXP02FU93K.21.81.H04.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgtactggaaccagcggtgacgttggtcttangactatgtctctgtacaacaataccagacaaacgccccaaatcatctatttatgatgtacagtaactccggccctgtacgggtttctaacgtcgtcttctcgtaggcccctaccaagtcgtacggaccaaccgaccggtccctcccgtacgacctactccgttacggtcggggtcccttacccgaggtcccttaggaacgttacgggaacggtacggtaccgttaggttaactttaacgttaccgtagaccgtaaacggttacctaaagtttaactaaaccgtaaattaccgaaacgtacctaaaacgttacctttaagttacggttaccgggttacgggtaaccggttaacggggaaaccctaaagtaccgtaccgtacccgttacgtacggtaccgaaccgaaccccgaaacggaccccaaaaccctcgtacgtacctacctttcccg

SEQ ID NO: 332041 - DNA, 771 bp, Homo sapiens
  misc_feature: GZ8MTXP02HNZON.21.81.H04.1.454.CMB.2.raw
  modified_base (243)..(243): a, c, t, g, unknown or other
  misc_feature (243)..(243): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacatacccaggcaaagcccccaaatcatcatttatgatgtcagtaatcggccctcaggggtttctaatcgtcttctctcggtcctcctaagtttcggactaaccgacgggtccctaccccgttgaaccctacgttccgtcgttcggggcccgttacccacgggtcccgtgtaaacgttcggaaccgggtaaacggtcccttagggtaaacttttaacgtttaaccgttacgggtaccgttaaccgggttaacttaaacgtttaaacgttaacctaaaaccgtttaccaaacggttacctaaaaccgtaaaccgtttttaacgtttacggttacccgttttacgggggtaaccgttaaccgggggtaacccttaaaacggggaccctttaaccggaaaccccggttaccccgttaacgggttacccgaaacggttaaccccccgaaaacggggttacccccaaaaaccccccgtacggttaccggtttaccccaaaacgttttcccccg

SEQ ID NO: 332042 - DNA, 583 bp, Homo sapiens
  misc_feature: GZ8MTXP02HX4LE.21.81.H04.1.454.CMB.2.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagtcgtcgctcgcacgaccggtgctcgatttagtagtgtagattcgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcnctgcatggaaccngcggtnacgttgtcttangactatcgtctctggtaccaacaataccaggcaaacgcccaatcatcatttangtatgtcagtaatcggcctntaggggtttacaatcgtctctctcggctcaagtctggcaacncggacctccngaccatctctcgggcncccgaggtcctaggaagtacgacgagtacgtagtattacttacgtagagtacgtacgtaataataactaactacgaacgtaactaactaacttaagttacgtacgttacggtacggtacggaaacgaaacgtaacgtaaccgtaccgtaccgtacgtaccgtaaccgacccgaaccgacccgaaccctaccgtaccgtactaccg

SEQ ID NO: 332043 - DNA, 608 bp, Homo sapiens
  misc_feature: GZ8MTXP02IA018.21.81.H04.1.454.CMB.2.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtnacgttggtctttangactatgtctctgtacaacactaccagacaaacgccccaaactcatcatttangatgtcagtatcggcctcgaggggtttctaaatcgcttctctcggctccaagtctggccaacncggtccctccctgacctactcgtcgtcgggctccgaggctggattgacgacgggtcttgaatttattacttgacctagggtccaattaactacaaattaccgagtaccaaactaacgttattcggtacgtttacggggaacttacgggggaacccaaaggtaaacttcccgtaaacccgttcccgttaaggtaccaacggtaacccccaaacgggacccccaaaaccccctacgttcggtccttaaccg

SEQ ID NO: 332044 - DNA, 742 bp, Homo sapiens
  misc_feature: GZ8MTXP02I4JQG.21.81.H04.1.454.CMB.2.raw
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcggtgacgtttggtctttatgactatgtctcctggtaaccaacaactaccaggacaaacgacccccaaancaatcatttangatgtcagtaactccggaccctagtacgggtttctaacgtcgtcttctctcggacctccgaagtctacggaccaaaccgccggtcccttacccgtacgtaaccccaatttcccgtcggtccggggtacccttacccggacgggtaccttacggtaacttcggggaaaccggtacgggtaccgtttaagttaaactttacgtttaaccggtggtaaccggtacgggtttaacctaagttaaaccttaacgtaaaacttaccggaaacgttaaccctaaaaccttaacgttttaacgttacggtttacccgggttaacggggtaaaccggttacggggaaacctaaacggtacctaccggttaaccccgtaccgttacggtacccgaaaccgacccgaaacggccccctaaacccgtactttcgaccctttaacccg

SEQ ID NO: 332045 - DNA, 601 bp, Homo sapiens
  misc_feature: GZ8MTXP02GZ0N5.21.81.H04.1.454.CMB.2.raw
  modified_base (245)..(245): a, c, t, g, unknown or other
  misc_feature (245)..(245): n is a, c, g, or t
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccaggcggtgtacgttggtctttangactatgtctctggtaccaacaataccaggacaaacgcccccaaactcatactatttatgtatgtacagtaatccggtccctcgtacggggtttctaactcgtcttctcgtcgcctcctaagtctcggaccaacnccggtccctcccgtacgacctactcgtcgtcgggcctccgagtctgagtgacgnggctgtattactactgctagtctatataacgtaatacaacacaactacgttactacgttccggttacggtaccgtacgggtaacctaaacgtacgtaccgtacccgttaccgtagggtccaaccgacccgaaccggtacccaacccctacgtccgtaaccgttcccg

SEQ ID NO: 332046 - DNA, 596 bp, Homo sapiens
  misc_feature: GZ8MTXP02JP3OZ.21.81.H04.1.454.CMB.2.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (369)..(369): a, c, t, g, unknown or other
  misc_feature (369)..(369): n is a, c, g, or t
  modified_base (479)..(479): a, c, t, g, unknown or other
  misc_feature (479)..(479): n is a, c, g, or t
  modified_base (581)..(581): a, c, t, g, unknown or other
  misc_feature (581)..(581): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactntgtctctgtaccaacaataccaggcaaacgcccccaaatcatacatttatgatgtacagtaatcggccctcgtaggggtttactaactcgtcttctctcggctacaagtctggaccaacnccggtccctcctacgacccaatcctcgtcggggtacctcccgaggctacggatcggacgacggcttagtatttaactacgttggctaggtcaataacttaacaaatcaanactaaactacttaactggtcttacggggtactacggggaaaccaaggactacctacccgtacgttacggaacaacgaccccgaaacggacccctaaaccccnctacgtctaaacccg

SEQ ID NO: 332047 - DNA, 661 bp, Homo sapiens
  misc_feature: GZ8MTXP02IF4ZI.21.81.H04.1.454.CMB.2.raw
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (442)..(442): a, c, t, g, unknown or other
  misc_feature (442)..(442): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgctactggaaccagtcgggtgtacggttggttactttagtcgtacttagtcgtcctccgtacggtaaccaaacactaccgacgacaaaccgaccccaaatcaatctaatttanagtatgtacaagtactcggcctagtaggttcactcgtntcgntccgctacgagtntgacaacnccggcctccacgtaccactcgtactcgggactacgagtcgacgtagtacgaacgnggtactaggtaattattacgtagtcgtaacggtattaaagtactaactaaactgaaaacgtaccaaacttacttaagttcgttaacggtaccggtaacgtacggaaaaccgtaaacgttaacgtacccgtaaccccgttacgttaaccgggtaacctaaccgggtaaccccaaaaccggggtccccctaaaacctaccggttactttaaccctaccccg

SEQ ID NO: 332048 - DNA, 685 bp, Homo sapiens
  misc_feature: GZ8MTXP02IVESU.21.81.H04.1.454.CMB.2.raw
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (317)..(317): a, c, t, g, unknown or other
  misc_feature (317)..(317): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcaccntcctcctgcacgtggaaccnggtcggtgtacggttggtctttagngacttatcgtctccgtaggtaccaacaactaccagaccaaacgacccccaaactcatactatttangtatgtactaagtaacgtccggtccctacggtacggggtttactaacgtcgtcctttactcgtcggccttaccgaagttccgtagtaccaaccgtccggtccctccgtacgaccctatccgtcgtcgggtcctaccgaggtcctaggtacgtcggtaacggacggttacgtaggttaactttacgttacgttacggtacgtaaccggttaattacttaaacgtaactaaacttaccgaacgtaacctaaacttaaacgtttcgttacggttacggttacggaacgtacgggaacctaaacggtctaccgtaccgtacgtacggtaccaaccgacccgaacgacccaaacccctacgtctacctacccg

SEQ ID NO: 332049 - DNA, 669 bp, Homo sapiens
  misc_feature: GZ8MTXP02GU75T.21.81.H04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccnggcggtgacgttgtcttangactntctctaccgtgtaacaacactacccagaccaaacgaccccaaatcatctatttngtatgtactagtaacgtccggtacctacggttagggtttactagtcgtccttctcgtaccggtcctaccgtaagtccgtacggacctaacgcccggtaccctcccgtagtaccctgtcgtcgtcggcctcgaaggtctacgagtcggaaacgtgggtacccctaggttacttaacgttacgtacgcgtaacgtactaactaactaacgaacttacgaacgaaacttaacggttaaccttaggttaccgttacggttaccgggtaactaccggggttaaacaaacggttaacctaccgtaccggttactaccggtaaccgaaccgtaaccccggacaaacccctacccgtaactcgtacctaaccccg

SEQ ID NO: 332050 - DNA, 726 bp, Homo sapiens
  misc_feature: GZ8MTXP02HT8QC.21.81.H04.1.454.CMB.2.raw
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctncactggaaccnggcggtgtacgttggtctttatgtactatgtctcctaggtaccaacaactacccaggacaaaccgcccccaaatcatctatttatgtatgtactaagtaactcccggtacccttacgttacggggtttactaaacttccgtcctttcgtcgtccggtcctaccgtaacgttccgtaggaccctaaacgccccgggtcccttacccgtacgacccctaattcccgtcgttcggggcccttaccgacggtccgtaggtacgttagggtaccggaaggttccgttaacggttaattttaacgttaacgtcggtacccgtaaagggttacttaaagttaaacttaaaccaaacttacaaccgtaactaaaaccgttactttaagtcggttttaccggtaccggggtaaccgttaacggggaaccctaaaagtcccgttaccctaccggttacgttaccggacgaaccgacccgaaccgtaccccaaaccctcgtacctaccttcccg

SEQ ID NO: 332051 - DNA, 783 bp, Homo sapiens
  misc_feature: GZ8MTXP02GOZPM.21.81.H04.1.454.CMB.2.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (320)..(320): a, c, t, g, unknown or other
  misc_feature (320)..(320): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccnggcggtgtacgtttggtctttangtactatgtctcctggtaaccaaacaactacccgaggaccaaaaccgaccccctaaaatcatactaatttangatgtacaagtaactccggtcctgtagggtttactatcgtctctcgtccgtctacgtaagtcgtacggacctaaacgcccgggtccctaccgtacgaaccctcttcgtccggtacgggtccctaccgacggtcgttacggacgttaccggggaaccgttaaggggtccttaaggtttaactttaacgttaccggtacggtaacccgtaggttaaacctaaagttaaaacttaacgttaaacgacctaaaacggtaaacccttaaaaccgtttaactttaacgttacgggttcccgggtttaacccggggtaacggttaaccgggggaaaaccctaaagggtaacccttaaccccgggttaaaccccgttaacggttaacccgggtaacccgtaaacccggtaaccccccggtaaaacggaacccccctaaaaccctcgggtttacccaccctttaaacccccg

SEQ ID NO: 332052 - DNA, 731 bp, Homo sapiens
  misc_feature: GZ8MTXP02FYQDC.21.81.H04.1.454.CMB.2.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (314)..(314): a, c, t, g, unknown or other
  misc_feature (314)..(314): n is a, c, g, or t
  modified_base (456)..(456): a, c, t, g, unknown or other
  misc_feature (456)..(456): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatctctgcactggaaccngcggtgtacgttggttacttangactatcgtctcgtacgtacaacaactaccgagaccaaaccgaccccctaaactcatctaatttacngtatgtactaagtacgtccggtcccgtacggttacggggtttactaacgtccgtacttcgttcgtcggtcctacctacggttctcgggaccaccggtccggtccctcccgtacgaacccgtctacgtcggtacgtcctacgnggtctaggagtcgacggacgttgtagttaagttacttcgtacgtacgtacggtaacttaacgttaactaactaaacgtaacccgaaactaaccctaaacgtttaactttacgtttaccgggtttaacggttaaccggggtaaacgttaacggggaaaccctaaacgtaccgttaacccggttaacccgttaccgtaacggtacccgaaaacccggtaaccccgaaaaccggaccccccctaaaacctttccgaaccggtttacctttaacccccg

SEQ ID NO: 332053 - DNA, 581 bp, Homo sapiens
  misc_feature: GZ8MTXP02IRW89.21.81.H04.1.454.CMB.2.raw
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaataccagcaaagcccccaaactcatcatttangatgtcagtaatcggccctcgtaggggtttctaatcgtcttctctcggctaccaagtctggaccaacncggcctccctgacccatctcgtcgggcctccgaggctgatagacgagctgtaattatactgctaggtcataactacaatcaagacaaacaactttaagtcgttacgtacgggtacgtacggggaaccaaagtacgtaccgaccgttaccgtaaggttaccaaccgaccccgtaaaacgggacccccaaaaccccgtacgttacggtacctaacccg

SEQ ID NO: 332054 - DNA, 654 bp, Homo sapiens
  misc_feature: GZ8MTXP02FH8EU.21.81.H04.1.454.CMB.2.raw
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
  modified_base (379)..(379): a, c, t, g, unknown or other
  misc_feature (379)..(379): n is a, c, g, or t
tcagtcgtcgctcgcacgaccggtgctcgatttagtagtgtagattcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccagcggtgacgttggtctttangactatgtctcctggtaccaacaatacccaggacaaacgcccccaaactcatcatttangatgtcagtaatccggccctcaggggtttctaatcgctttctctcggtctccagtctggcaacgccgcctccctgaccntctcgtgggtcctccgaggctagatacgacgaggtccttaggtatttaacttacgtgaccgaaacggtcctaaatacgttaaacccaaattcccggaaacgacctaaaacgttaccttaaagtacggtttcccgtttaacgggggaaccttacgggggaacccaaaacggccttacccgaaaccccgggttccttaacgggggtaccccaaaccggacccccgttaaaaccggggaccccccaaaacccccgtacgtccgtaacccttacccccg

SEQ ID NO: 332055 - DNA, 602 bp, Homo sapiens
  misc_feature: GZ8MTXP02FKJ6I.21.81.H04.1.454.CMB.2.raw
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
  modified_base (481)..(481): a, c, t, g, unknown or other
  misc_feature (481)..(481): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctcctggtaccaacaatacccaggaccaaacgacccccaaactcaatctaatttangtatgtcagtaactccggccctcgtaggggtttactaatccgtctttctctcggtcctccaagtctaggccaacnccggcctccctagaccctatcctcgtcgggtacctccgtaggctagatacgacgaggtctagtaattatactagacgtaggtacatataacaatacanactaactacttatcgttacgtacgggactacgggacaaacgacttacccgaccggtacctaacggtaccgaacgtaccccgaaaccggaccccctaaaccccgtactcgtacctttaaccg

SEQ ID NO: 332056 - DNA, 605 bp, Homo sapiens
  misc_feature: GZ8MTXP02JF84C.21.81.H04.1.454.CMB.2.raw
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcatcacatctcctgctacgtcggaacaggtcggtgtacgttggttcttangtatatgtctctgtaaccaacacacagaccaaacacccctaaanctaatctatttangtatgtacaagtactcggtccctagtacggtttactaatccgtactctctccgcctaccagtctcgacaacnccggcctctanaacctntcgtcgcggctcgtacgntacgtagtcgactacggtacttaggttacttacgtatagaccggtaataccgtataaactaactaaactcgaaactactaaacgttattacgttacggtcgtaacggacgtaacggacaaacgtactaaaccgtccgtaacgtaccgtacgaaccgaacccaaccgtaccccaaacgtcctaacgtactaccccg

SEQ ID NO: 332057 - DNA, 738 bp, Homo sapiens
  misc_feature: GZ8MTXP02GEYUG.21.81.H04.1.454.CMB.2.raw
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (316)..(316): a, c, t, g, unknown or other
  misc_feature (316)..(316): n is a, c, g, or t
tcagtcgtcgctcgcacgaccggtgctcgatttagtagtgtagattcgcgggggggggtctcaggaggcagcactctcgggacgtctccaccatggcctgggctctgctattcctcaccctcctcactcagggcacagggtcctgggcccagtctgccctgactcagcctgcctccgtgtcgtgggtctcctggacagtcgatccaccatcctcctgccacgtacggaaccgaggccgggttggtacggtttggttactttangtactntcgtctccgtggtaaccaacactaccaggaccaaaccgaccccaacncatactatttatgtattagtactaggttaacgtccggtacccgttaggttacggggtttactaacgttcgtccttacgtccgtcgtcctactagtacgtcggaacctacgtcccggtccctccggtactacctcgttcgtccggtcgggtcctacggacgtcgtcgtaggtacggacggtacgtcggttaactttattacgttagttacggtacgtaaggttactaaacttaactaaacgtaactaccgtaaacgtaaaccttaaccgttaagtttacggtaccggttttacggtaaccggggtaccggtaaaccgggaaacgttaaacggtacccttaaccccggtaacgtacccggtaacggtacccgaacccgtacccgaaaccgtacccccgaaccgtacctccgtaacccttccccg

SEQ ID NO: 332058 - DNA, 605 bp, Homo sapiens
  misc_feature: GZ8MTXP02HDFMW.21.81.H04.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (293)..(293): a, c, t, g, unknown or other
  misc_feature (293)..(293): n is a, c, g, or t
  modified_base (591)..(591): a, c, t, g, unknown or other
  misc_feature (591)..(591): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccaggcggtgacgttgtcttangactntgtctctgtacaacataccagacaacgccccaactcatctatttangtatgtacagtaactcggccctacgtacgggtttctaacgtcgtcttactctcgtcctacctaagtctcggacaacgtccggccctcctacgacctacttcctcggtcgggtccttccgacggtctgtacgtacggacggtagggtcttaggttaactttacgttacgtagtaccgttaaggtactaaattactaactaagtacaacgtactaaacgttacttagtacgttacgtacgggtaacgtacggaacctaagactaccgtacgtcgtagtcaacgacctaacgacccaaccnctaccgactacccg

SEQ ID NO: 332059 - DNA, 569 bp, Homo sapiens
  misc_feature: GZ8MTXP02JAM5B.21.81.H04.1.454.CMB.2.raw
  modified_base (297)..(297): a, c, t, g, unknown or other
  misc_feature (297)..(297): n is a, c, g, or t
  modified_base (363)..(363): a, c, t, g, unknown or other
  misc_feature (363)..(363): n is a, c, g, or t
  modified_base (421)..(421): a, c, t, g, unknown or other
  misc_feature (421)..(421): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttatgactatgtctctggtacaacataccagcaaacgccccaaatcatctatttangatgtcaagtaatcggccctcgagggtttactatcgtcttctctcggctccaagtctggaccaacncggccctcctcgtaccatcgtctgggcctcgagctgatgacgagcgtgtattattacngacctaggtcataactacaaattccaagaccaataactttagtacgttcgttacggacgtacgggtaccaaaacgtactcctaacccgtccgtaacggtacaacccggtaccgaaacggacccccaaacctacgttacgtacctaacc

SEQ ID NO: 332060 - DNA, 684 bp, Homo sapiens
  misc_feature: GZ8MTXP02GOJTK.21.81.H04.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttgtctttangactatcgtctctggtaccaacaactaccaggacaaacgacccccaaatcactactatttatagtatagtacgaagttaacgtccggtacccttacgggttaacgggttttacctaaagtccgttccttcgttccgccggtcctaccgtaacgtcgtacgggacctaaaccgcccgggtccctacccctagaccctacgtccgttacggtcccggggtacctccgacgggtccgttaggacgttacgggaacggtacggtacgttacggtaacttttaacgtacgtacggtacgtaggttactaacttaaactacgaacttacgaacgtactaaacttactttctcggttacgttacgggaacgtacggaacgaactcgtaccgtaccgtacgtacggtaccaacgacccgtaacggacccaaccctagtcctaccttccg

SEQ ID NO: 332061 - DNA, 613 bp, Homo sapiens
  misc_feature: GZ8MTXP02IVVQG.21.81.H04.1.454.CMB.2.raw
  modified_base (255)..(255): a, c, t, g, unknown or other
  misc_feature (255)..(255): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (441)..(441): a, c, t, g, unknown or other
  misc_feature (441)..(441): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacctatcctcctgcacgtggaaccaggcggtgacgtttggttctttatgactntgtctctggtaccaacaatacccaggacaaaccgacccccaaactcatcatttangtantanagtatccgccttagtaggtttcaatcgtcttctcgtcgctctaagtcngaccacnccggcctccnacctatctgtcggaccttcaggctagatacggacgtcgacttagtaactttagttacgngtaccgaggttactaattaaccgtaacaaacgtacgaagtaacctaaacttacgttaagttccgttacgtacggggtaccgtaggtaaacccgtaacgtactacccgttaccgtaacgtcggacgtaaccgaacccgaaccggtaccccaaccgtacgtcgtacctaacccg

SEQ ID NO: 332062 - DNA, 702 bp, Homo sapiens
  misc_feature: GZ8MTXP02HDUE4.21.81.H04.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcggtgacgttgtcttangactatgtctctggtaccaacaactaccaggacaaacgcccccaaactcatctatttatgatgtacaagtacgtccggccctacgtaggggtttactaagtcgtactttctcgtcggtcctaccgtaacgtcgtacggaccaaccgtaccgggtccccttccctcgaaccctatccgttcgtcgggtccctaccgacggtccgtaggtaacgtacggacggtaacggtcgttagggtaaactttaacgtttaccgtacggtaaccgtaaaggggtttacctaaagttaaacgttaaaccgtaaacttacccgtaaacgaaacctaaacctttaaaccgtttaagttaccggtttaaccggtttacggggtaaaccgttacggggaaacctaaaggtacctacgtacccgtacgtacggtaccaacgacccgacgaccccgaacctacgtacgtacctaccg

SEQ ID NO: 332063 - DNA, 645 bp, Homo sapiens
  misc_feature: GZ8MTXP02IYNO0.21.81.H04.1.454.CMB.2.raw
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
  modified_base (368)..(368): a, c, t, g, unknown or other
  misc_feature (368)..(368): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcactggaaccngcggtnacgttggtctttangactatgtctctggtaccaacactacccaggcaaacgcccccaaatcatcatttangatgtacaagtaatccggcctacgtaggggtttctaatcgtcttctctcggctaccaagtcgtggacaacncggccctcctgacctatctcgttcgggctcccgagtcctagagtcgaacgtaggcttagtaattatacgtgacgtaggtactaagtaactacaaactacaagtaacctaaacgtaactttaacgtcgtttaccgttacggggtaaacgttacgggggaaaaccctaaaggtaaccttaacccgtaacccggttaacccgttaacggttaccgtaaaccggacccccgtaaaacggtccccccaaaaaccccgtacgttccggtaacctttaaccccg

SEQ ID NO: 332064 - DNA, 718 bp, Homo sapiens
  misc_feature: GZ8MTXP02JQ8S7.21.81.H04.1.454.CMB.2.raw
  modified_base (304)..(305): a, c, t, g, unknown or other
  misc_feature (304)..(305): n is a, c, g, or t
  modified_base (493)..(493): a, c, t, g, unknown or other
  misc_feature (493)..(493): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccaggcggtgacgttggtcttatgactatcgtctccgtaggtaccaacactaccaggcaaacgccccaaatcatctatttannatgtacagtaactcggccctgtacgggtttctaactcgtcttactcgtccggtctaccgtaagtcctagggtacccaaaccgtacccggcccttacccgtacgacccctaattcccgttcggtccgggacccttccggaggtcccttaggacgttacggacgtagggtctaggtattaagtttaccgngtacgtacgtactaacttaactaactaacgtaccgtaacgtaacctaaacgtttacgttacggttacgttaccgggtttaaccggggtaaaccggtaaccggggtaaaccgtaaaccggtacccgttaacccggttaccccggtaccgttaaccggtaacccgtaacccggaaccccggtaacccgtaacccccgtacccgtaccgtttaccgtacccgtacccg

SEQ ID NO: 332065 - DNA, 784 bp, Homo sapiens
  misc_feature: GZ8MTXP02FMUEB.21.81.H04.1.454.CMB.2.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
  modified_base (301)..(301): a, c, t, g, unknown or other
  misc_feature (301)..(301): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacngtcgatcaccatctcctgcactaggaaccaggcggtgacgttggtctttangactagtcgtctccgtggtaaccaaacaactaccgagaccaaacgacccccaaacnctatactatttatgtatgtactaagtacctccgggtaccctacggtaggggtttaccttaacgtccgtcttcctcgtccgtacctaccgaagtccgtaggacctaccgacccggtcccctccgtacgacctacttcgtacgtcgggtccctccggaggtacctaggtacgtacggaaccggtaggtaccgttaggttaactttacgttaaccggtcgaacggtacggtactaaacttaaacttaaacaacgtaacctaacggtaaaccctaaacgtttacgttaacgtttaccgggttaccgggtttaaccggggttaaaaccggtaccgggggttaaacccaaaacgggtttaaccctacccgggttaacccccggttaaccggttaaaccccgggtaccgtaaccccggaaacccggtaaacccccggttaacccccaaaaccccggtttaccttaccggtaaacccccgttttacccccg

SEQ ID NO: 332066 - DNA, 632 bp, Homo sapiens
  misc_feature: GZ8MTXP02HLHWJ.21.81.H04.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccnggcggtgacgttgtcttangtactntgtctctagtacaacacaccagacaacgaccccaaatcatctattatgatgtacaagtaacgtccgccttagtacgggtttctaacgtcgtcttcgtacgtccggtacctacgtacgtctacggaccaaccgcccggtaccctaccctacgtaacctacttccgtcgttcgggaccctcgagtctggatacggacgacggtctagtaactttacgtacgtgactacgtactaatataacaagtcgaacgtacaaactttcgttagtacgttccggtacggtaccgtacggaaaccttaaacaccgttaccgtacccggtcgtaacggtaccgaaccggtaaccccgaaccggtacccccaaaccgtcgtacccgttaactcccg

SEQ ID NO: 332067 - DNA, 746 bp, Homo sapiens
  misc_feature: GZ8MTXP02JV971.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgtacgttggtctttatgactatcgtctccgtaggtaaccaacaactaccccgaggaccaaacgacccccaaactacactactatttatgactgtcaagtaactccggtccccgttcgtacggggtttactaacgttccgtcttcgtctccgggacctaccgtaagtcgtcggaccaaccgtacccggtccctacccgtacgacctactccgttaccggtcgggtcccgtaccgacggtcgtacggtacgtacgacgggtacgtacgttagtaactttacgttacgtacggtacgtacgggttactaatacggttaaactaaacttaccaaccggtaacctaaacgttaaccgtttagttccgttacccgggttaccggggtaacggtaccggggtaaaacgtaacccggtacgttacccggttaacccgggtaccgttaaccggttacccggaaaccggtaaccccgaaacccgggaccccctaaaccccggtccgttacctaccgtttacccccgg

SEQ ID NO: 332068 - DNA, 610 bp, Homo sapiens
  misc_feature: GZ8MTXP02GL6Q0.21.81.H04.1.454.CMB.2.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctctgcactggaaccnggcggtgacgttgtctttangactatgtctcgtggtaccaaacaatacccaggacaaacgacccccaaacncatcctatttangatgactatagtccggccctagtacggggtttactaatccgtcttctcgtcgtacctacagttcgtacggaccaacgaccggtcccctccgtacgacctatccgtcgtcgctaccgaggccttagagtcgacggtagtacgttagtaagtttaccttacgtggaacgttacggtacaagttaacaaactaactacgagaactaagttacttagtcgttcgtttacggacgttcggaaactaacgtactacgtaccgtcgtagtacgaaccgacgaacccgtaccacccctaacgtcctactaccc

SEQ ID NO: 332069 - DNA, 694 bp, Homo sapiens
  misc_feature: GZ8MTXP02JWO8H.21.81.H04.1.454.CMB.2.raw
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (300)..(300): a, c, t, g, unknown or other
  misc_feature (300)..(300): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcatgaccagcgtgacgttgtntttantactatgtctccgtgtaccaacactaccccaaggccaaacaccccaaatccaatctatttangtatgtacagtaacgtccgtaccgtacgtagggtttctaatccgtacttcgtcgtccgtactaccgaagtctacggacctaaccgcccggtcccttacccgaagtaccctgttcccctcggttccgggaccttcccggaaggtccgttagaaccgttaggacggacgggtcttaagtaattttacgtacctaggtagtaaccggtataaagttaaacttaaaactaactaaccgtaacgtaaacctaaacttaacgtttaacgttacggttaccggttaccggttaaccggtacggtaaaccgaaacgtaaccgtaccgttacccgtaccgtacgtaccgaacccgaacccgtaaacccgtaccccgtaaccctaccgtaccgtaccgtacccg

SEQ ID NO: 332070 - DNA, 801 bp, Homo sapiens
  misc_feature: GZ8MTXP02GO9QF.21.81.H04.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
tcagtcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatctctgcactggaaccngcggtgtacgttggtctttangactatgtctccgtaggtaaccaaacaactaaccgaggacaaaccgacccccaaactcaatctaatttangtatgtactaagtaagtccgtaccgtacgtaaggggtttactaactcgtacttctcgtcggtactacgaaacgtcgtaggaaccaacggtcccggtacccttacccgacggtaaaccctacttccgttaccggtacggggtacccgttccgtaaacggtcttacggtacgtacggggttaacccggagggttaacccgttagttaaacgtttaaccgttaacggttaccggtaaccggtaaaggttaacctaaacgtttaaacttaaaacccggtaaataaaccccgggtaaacgtaactaaaacccgttaactttacggtacggtttaccgtttaccgggggaaccgttaaacggggaaaccgtaaaacgtaaccgttaacccgttaccccggtaacggttaaccggacccgtaaaaccccggaaacccgtaacccgggtaaaaccccgaaacccccttcgtaaacccggtcttaaacccccgg

SEQ ID NO: 332071 - DNA, 775 bp, Homo sapiens
  misc_feature: GZ8MTXP02G1KNG.21.81.H04.1.454.CMB.2.raw
tcagtcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatcctctgcacgtacggaaccaggtcggtgtacggtttggttactttagtgtacttatcgttacgtcctaggaaccaaactaactaacccgagaccaaaaccgtacccccaaaatcaactacttaatttactgtaactcgtactaaggtaccgtccggacccgttaggttacggtttaacactcctttaccgtcttacgtcccggtaccttaacgaacgtttcgacgacccaaccggtaccccggtccctacccgtacgtaccccttagttcccggtaccggtacggttcccgaccgtacgggtacctaggtaccggttaagaccgggtaacggtaccttaaagttaacctttaagttaccggtacggtaacggttaaccggtaacttaaagttaacttaaacgaaacgttaccaaacgtaaaccttaaagttacgttacttacggggtttacccggtaacggtacggtaacgggtaaaccaacgtacgtaaccgttacccaacggtttcgaacccgaaccggaccccaaccggaacccctaaccccggtattacgtaccctacccgg

SEQ ID NO: 332072 - DNA, 557 bp, Homo sapiens
  misc_feature: GZ8MTXP02FWLVD.21.81.H04.1.454.CMB.2.raw
  modified_base (243)..(243): a, c, t, g, unknown or other
  misc_feature (243)..(243): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (451)..(451): a, c, t, g, unknown or other
  misc_feature (451)..(451): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttangactatgtctctggtaccaacaatacccaggcaaacgcccccaaatcatcatttatgatgtcagtaatcggccctcaggggtttctaaatcgcttctctcggctccaagtctggcaacncggccctcctgacccntactctgggcctcgagctgatgacgaggctgattatactgcaggtcatatacgaatcagacaaacactttaangtacgttcgggaacttggggaaccctaaggacttacgacccgtaccgtaagggtcccaacggaccccgaaaacggaccccaaaaccccacgtacgtacctaacccg

SEQ ID NO: 332073 - DNA, 668 bp, Homo sapiens
  misc_feature: GZ8MTXP02IJDGJ.21.81.H04.1.454.CMB.2.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcatcacatctctgcactggaaccagcggtgacgttggtctttangactatgtctcnggtacaanataccagcaaagccccaaancatcatttangatntacagtaatcggtaccctgtacggggtttctaaagtcgtctttctacgtggtacctaccgaaacgtcgttggaccaaacgtaccggccctttaccctacggacctacgttctcgtcgggccttaccgacggcttagagtagaccggagggtcctagtaatttattaactggtactacggtactaagttataactaaattacgtaacgactaaactactttaaacttcggtttaccttacgggggtaacgttacggggaaacccgaaaacggtattaacccgaaccgttaccgttaacggggttacctaacggaaacctaaaaccgggggaacccccaaaacccccggtaccttaacggtttacccgtaaacccg

SEQ ID NO: 332074 - DNA, 524 bp, Homo sapiens
  misc_feature: GZ8MTXP02JAR7G.21.81.H04.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (264)..(264): a, c, t, g, unknown or other
  misc_feature (264)..(264): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcggtgacgttggtctttangactatgtctctggtaccaanaatacccaggcaaagcccccaaactcatcatttatgatgtacagtaaatcggaccctctaggggttactaatcgcttctctcggcctccaagtcnggtccaacnccggcctcccngaccatctctgggctccaggctgatgacgagctgacttattactgactaggcatatacaaatcagactaacacttatagtctacggcttagggaccaaagactcaccgtccagtcaagcccaaggcccaaccccgatcgtctaac

SEQ ID NO: 332075 - DNA, 721 bp, Homo sapiens
  misc_feature: GZ8MTXP02JMW4T.21.81.H04.1.454.CMB.2.raw
  modified_base (330)..(330): a, c, t, g, unknown or other
  misc_feature (330)..(330): n is a, c, g, or t
  modified_base (468)..(468): a, c, t, g, unknown or other
  misc_feature (468)..(468): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggaccagtcgatcaccatctcctgcactggaaccgaggcggtgtacgtttggttacttataggtacttatcgtcctccgtacggtaaccaaactaaccgaccaggaccaaacccgaccccctaaatcactacgtatttangtacgttatacgtaagtaaccgtccggtacccttagggttaacggtttctaaacgttccgtccttcgttccgtccggaccttaccgtaagttccgtacggaacccacgtacccggtcccttaacccgacgtaaccctntccggtccgtcgggtacctcccgtaaggtcagtaaccgggcgacggtaccgtagtttacttagttacgttacgaggtaccgtaagtaactaacgttaactaactaactacgaactaaaccttacttaacgtcgttaccggtacggtacggtaacgtaacggaaaccacgtaacgttacccggtaccgttaaccgacgaaccctaaccggaaccccgacccgtaacccgaccgttaccgttacctcccgttacc

SEQ ID NO: 332076 - DNA, 678 bp, Homo sapiens
  misc_feature: GZ8MTXP02JL440.21.81.H04.1.454.CMB.2.raw
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatcctctgcactggaaccaggcggtgtacgttggttctttatgtactatgtctccgtgtaccaacaactaccaggacaaacgaccccaaactcatctatttatgatgtacagtactccggtaccctagtagggtttctaagtcgtacttctctccgtcctacgagtctaggacctaaccgccgtccctcctcgaccctatctcgtacggcctaccgaggcctgacgtcgacgtaggacttagttattacgttacgtagacgtacggtactaaacttaactaagaacttaccgaactactaaaaccttacgtttaagttaccgggtttccgttaacgggggtacccgttaacggggaaacccgtaaaagttacccgtacccgtaacccggttaccgttaaccgggtacccaaccggaccccgaaaaccgggacccccctaaacccgtaccgtttaaccggacctttaaacccccg

SEQ ID NO: 332077 - DNA, 604 bp, Homo sapiens
  misc_feature: GZ8MTXP02FFM3V.21.81.H04.1.454.CMB.2.raw
  modified_base (244)..(244): a, c, t, g, unknown or other
  misc_feature (244)..(244): n is a, c, g, or t
  modified_base (448)..(448): a, c, t, g, unknown or other
  misc_feature (448)..(448): n is a, c, g, or t
tcagtcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggcggtgacgttggtctttangactatgtctctgtaccaacactaccaggcaaacgcccccaaactcatcatttatgatcgtacagtaactcggtccctctaggggtttctaatcgcttctctcggctacccaagttcgtggaccaaacgtccgccctcccttgacccatctacgtcgggcttaccgaggtctgagtcgacgacggctaggattattacctgacncggtcaatattaaacaattacaaacggtcaaacgttcttaatcgtttacgttacgggtacttacgggggaaccttaaacgagttacccaccggttacctacggttaccaacggaccccaacggtaccccaaacccccgtacttccggtacctaccg

SEQ ID NO: 332078 - DNA, 662 bp, Homo sapiens
  misc_feature: GZ8MTXP02HNJQ9.21.81.H04.1.454.CMB.2.raw
  modified_base (476)..(476): a, c, t, g, unknown or other
  misc_feature (476)..(476): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgcactacggaaccaggcggtgtacgtttggtactttatgactatcgtctcctacggtaaccaacaactaccccaggaccaaacgacccccaaactcatactatttatagtatgtacagttaactccggccctcggtacggggtttactaacgtcgtcttcgtcgtacggtcctaccaagtcgtacgaccaaaccgccgggtcccttacccgtacgacccttaatccgtcgtacgggtcctacgacggtctgagtcgaacggnggtacttagtactttacgtactaggcttacgtactaataataacatacgacacctaacgttacttaagtttccgtaggttaccgggtacgtaacggggactaaacggtactaccgtacccgtaccgttaacgaccgaaccggaccctaaacggaccccctaacccgtacgtccgtaccgtaccccg

SEQ ID NO: 332079 - DNA, 662 bp, Homo sapiens
  misc_feature: GZ8MTXP02GWUZ5.21.81.H04.1.454.CMB.2.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccngcggtgacgttgtcttangtactntgtctctggtaccaacaactaccaggacaaacgaccccaaactcatactaatttactagatgtactaagtaatccggaccctgtagggtttactaagtcgtcttcgtctcgtcctacgaagtcgtaggaccaacgaccggccctacctacgacctaacttcgtaccgtacggggtaccctaccgacggtacctggaacgttacggtaacgacgggtccttaaggtaattttaacttaccgttagaccgtaaggtacctaataacttaacaaattaccgaatacgtaaaactacgtttatacggtacgtttaccggggaacttacggggaaacctaaaggtacctaccgtaccgttacgtaacgtaccgaacgaccccgtaaaacggacccaaaacccctctaaccgtcttaacccg

SEQ ID NO: 332080 - DNA, 683 bp, Homo sapiens
  misc_feature: GZ8MTXP02IOPCD.21.81.H04.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (430)..(430): a, c, t, g, unknown or other
  misc_feature (430)..(430): n is a, c, g, or t
  modified_base (471)..(471): a, c, t, g, unknown or other
  misc_feature (471)..(471): n is a, c, g, or t
tcagtcgtcgctcgcacgaccggtgctcgatttagtagtgtagattcgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactcggaaccnggcggtgtacgtttggttctttangtactatgtctctggtaaccaacactaccaggcaaaccgaccccaaatcatactatttangtatgacagtaactccggtccctaggtagggtttacatccgtcttctctcggcctacaacgtcncggtaccaacgccggtcctcccacgtacccacttcgtcgttcgggacctcgcggtcngtatacggacgtagggtacttagttaacttacgtacgttanccggttaacggtaactaattaacctaaacggtaaactccggtaaactaacctaaaacttaacggtttaacgttcggtttacggtaaccggggtaccggttaacggggaaaacctaacggtaacttaccccggtaccgtaccggttacgtaacccgaaccgtaaccccggaaacgaaccccctaaaccccgtcttacccggtacttaaccccg

SEQ ID NO: 332081 - DNA, 701 bp, Homo sapiens
  misc_feature: GZ8MTXP02HP1NP.21.81.H04.1.454.CMB.2.raw
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctcgtgtcctgggtctcctggacagtcgatcaccatcctccngcactggaaccaggtcggtgacgttggtctttangactatgtctcctggtaccaaacaattacccaagggacaaacgtcccccaaaaactctatcaacttttatagtatgtcgtaacgtaaacgtccggtcccgtacgtacgggggttttataaacgttcgtcgtttcttccgtcgtactccgtaaactcgttaggaccaacgaccgggcccttaccctcgaccctaatcctcgtcgggccctaccgtacggtcgtagacttagggacccgaagggtcgtagttattaacgtttacgcggtcgtacggtacgtaacgttaataaactacttacgaaactacgaaaccgtactttaaacgtgtttaacgtaccggggtacttacgggggaaccaaacggtctaaccgtaaccgtcccgtttaacggggtcctaaacccggacccgaaacgggacccccttaaaacccccgtaccgttacgtacccttac

SEQ ID NO: 332082 - DNA, 688 bp, Homo sapiens
  misc_feature: GZ8MTXP02HAM8Q.21.81.H04.1.454.CMB.2.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatcnctgcacgtcgaaccnggtcggtgtacgttgttacttagngactntcgtctccgtaggtaccaanactaccaggacaaaccgccccaaatcacgtctaatttnagtatcgatagtacgtccgcctcggttaggttcatccgtactcgtcncggtcctcgtacgtcgtacgaccacgtcccggtccttccgacaccgtagttccgtcggtccgggccctacggaacgtccggtagagtacgtacggacggtcttaagtactttaaacgttcgtcgtaccggtaacggtactaaataacctacggtaaactccgtaaaagtcctaaaacgttcttaaggtccggttttaggaccgggtaaccgttaaaggggtaaccccgaataccgtaaaccggtttccgaccggttcggaaacccgtccgtaaaaccccggccggttaaaacccccgaaacctcggtttaaacccggctttaaacccc

SEQ ID NO: 332083 - DNA, 612 bp, Homo sapiens
  misc_feature: GZ8MTXP02F3JLQ.21.81.H04.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (338)..(338): a, c, t, g, unknown or other
  misc_feature (338)..(338): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
tcagtcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtcctgggtctcctggacagtcgatcaccatcctctgcactggaaaccngcggtgacgtttggtactttangactatgtctctggtaccacaatacccagaccaacgccccaatcatcatttatgatgctagtaatcgccctagtacgggtttctaatcgnttctcgtcggtctacctagtccgtggaccaacgccggtacccttcccgtacgtaaaccctcttacgtccgtacggggtcctaccgtaggcttagacgtagaccgtaggactagtattactaggtacgngtaaacggtntataagtaacctaattacccaagacctaactacttcgtacgttacgttaccggtacgtacggaaaccaacgtactaccgtaccgtacgtacgaccaaccgaacccgtaacgtacccaccgtacgtaccgtacctcc

SEQ ID NO: 332084 - DNA, 562 bp, Homo sapiens
  misc_feature: GZ8MTXP01EJZRZ.8.39.D06.1.454.CMB.2.raw
  modified_base (241)..(241): a, c, t, g, unknown or other
  misc_feature (241)..(241): n is a, c, g, or t
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctcagtgaagatttccngcaaggcgtccggatacaggttcaccgcgtactatattaatggctgcgacacggcccctaggacgaagggcctggagtggagtgggganaagtccgaaccccgaggtggaggtggtcgacgaaggnggtaccgcccgaaggtacgggtttcgaggggcaggacgtctaccagtcgaccaggtacgaccacggtccgcgacgctacgtgtactatagtggagagtgaggagccgtgagtactcgacgaacgacggcgtattacgttactggttagcgaagaacgtacggaaaggtaagggtcggactaacgaacgtaaccgg

SEQ ID NO: 332085 - DNA, 552 bp, Homo sapiens
  misc_feature: GZ8MTXP01BN8VS.8.39.D06.1.454.CMB.2.raw
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttccngcaaggcgtccggatacaggttcaccgcgtctatataatggctgcgacaggcccctggacagggcctgagtggagtggganatcgaaccccgnggtaggaggtggtgacgaggngtacgcccgaggtaggttcgagggcagagtctcgatcgaccagtacgacgacgtccgcgagcacgtgtactatagtaggagagtggagggacgaccgtgaacgtacgttcggaaccgaacgaccgggttaccgtaattacgttacgtggttacgcgaagtaagtacggaaaggaagggtggactaacgaagtaaccgg

SEQ ID NO: 332086 - DNA, 525 bp, Homo sapiens
  misc_feature: GZ8MTXP01CBHNG.8.39.D06.1.454.CMB.2.raw
  modified_base (241)..(241): a, c, t, g, unknown or other
  misc_feature (241)..(241): n is a, c, g, or t
  modified_base (358)..(358): a, c, t, g, unknown or other
  misc_feature (358)..(358): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctcagtgaagatttccngcaaggcgtccggatacaggttcaccgccgtctatattaattggctgcgacaggcccctggacaagggcctgagtggagtgggagatcgaacccccgaggtggaggtggtgacgagngtacgcccgaggaggtttcgaggggcagagtctccatgaccagtcgacacgtccgcgacgcacgtgtcgtatagtggagagtgaggagccgtgacgtacgttcgacgaacgacggccgtattagttacgtgttgcgagaatcgaaagaggtggctaacgaagtaacg

SEQ ID NO: 332087 - DNA, 628 bp, Homo sapiens
  misc_feature: GZ8MTXP01BXYFF.8.39.D06.1.454.CMB.2.raw
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
  modified_base (329)..(329): a, c, t, g, unknown or other
  misc_feature (329)..(329): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagngtccgtggggcctgagtgaagtntttcctgcaaggcgtccggatacaggttcaccgccgtntatattaatgctgcgacaggcccctggacgaacgggcctggagtggagtgggganatcgaacccccgaggtggaggtggtgacgaggcgtacgcccgaggtacggtttcgaggggcagacgtctaccgagtcgaccgaggtacggaccgtaccggtacccggacggacgccaacgttcggttaccttaagttaggtgggaaggtaggttgggggacgccgttaggaacgtacgttcggaacgtaaccggaaccggtccgttaagttagtttaccgtgggtacggttaccggaggttaaacgttaagggaaagggtaagggttcgggacttaacgtaacgttcccggtaaagggg

SEQ ID NO: 332088 - DNA, 589 bp, Homo sapiens
  misc_feature: GZ8MTXP01AGHS7.8.39.D06.1.454.CMB.2.raw
  modified_base (215)..(215): a, c, t, g, unknown or other
  misc_feature (215)..(215): n is a, c, g, or t
  modified_base (385)..(385): a, c, t, g, unknown or other
  misc_feature (385)..(385): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggganagccaccctctcctgcagggccagtgtaaccttttagtagttagttatttagcctggtatcggacaaaacctggccaggcctccccgactcctcttctttgggtgagcttacgagggcccacgtggccacccccgagacgaggatcgagtggcaggcgggtctagggacngacttcattctcacatacaacagactgctagcctagaagatattgactagtttactactggggtcagtctaagttattcggttaaccggtccccggtaggtaccggttccggaccgaaacggggacccgtaagggtcggacaaacttccgaaacccgaacgttggttcggctcggccaacctagtcttcgttcttcgttaaccc

SEQ ID NO: 332089 - DNA, 585 bp, Homo sapiens
  misc_feature: GZ8MTXP01CZGQZ.8.39.D06.1.454.CMB.2.raw
  modified_base (243)..(243): a, c, t, g, unknown or other
  misc_feature (243)..(243): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctcgagtgaagtatttccngcaaggcgtccggatacgaggttcaccgcgtctatattaatggctgcgacacggcccctggacaagggcctgagtggagtggggagatcgaacccccggaggtgggaggtggtgacgagcggtaccgcccgtaaggtacggtttcgaggggtcagacgtctccagtcgaccgagtcgacgacgtccgcgagcactgtactagtagtaggagagtggaggacgaccgtgaacgtacgttacggaacggaaccgaccgggttaccgttaagttacgttaccgtggttacgcggaaggtaaagttacggaaaggtaagggtacggacttaacgaacgttaaccgg

SEQ ID NO: 332090 - DNA, 526 bp, Homo sapiens
  misc_feature: GZ8MTXP01EV70T.8.39.D06.1.454.CMB.2.raw
  modified_base (359)..(359): a, c, t, g, unknown or other
  misc_feature (359)..(359): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtcctggggcctgagtgaagatttcctgcaaggcgtccggatacagttcaccgcgtctatataatgctgcgacacggccctggacgaagggcctggagtggagtgggggagaacgtacgaaccccggagtggaggtggtgacagngtacgccgagaggttcgaggggcagagtctcatgaccgagtcgacacgtccgcgagcactgtactagtagtggagagtgaggagccgtgagtacgtcggacgaacgacgggacctagttacttacgtgttgcgagaacgtaggaagaggtggactaacgaagtaacg

SEQ ID NO: 332091 - DNA, 775 bp, Homo sapiens
  misc_feature: GZ8MTXP01BOUY1.8.39.D06.1.454.CMB.2.raw
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctgggctgagatgaagagtccgtgggcctgagtgaagtatttccngcgaaggcgtcggatacgaggtcaccgtcgtctatatagtgctgcgacgcgcccgtagacgacggtcnggagtaggaggtagggaanaactaccggaacccggtaggtaggacgggtggcgaacgaacggaacgggtacccgacccgtaaggggttaccgttcggggaacggggtacgacggtaccgttacctaccgtaagacccgggtaaccgtaagggttacccgaaccgttacccgggtaccgggaccgaaacggtcccctaagtttcccggtaattaaggtttaaggggaacgggttaagacgggttaagggacgggtacccggttaaccgggttaggaaaccggttaaccgttaacggggaaaccccggttaaaacccggggccgggtttaaacccggttttaaaaagtttcttttaaaccccgggggtgggttaaaccggaccgggtttaaaaacggaaggttaaaccggggaaaacgggtttaggggaccggttaaaactaaaccgggttaaccgtttaaacgggggg

SEQ ID NO: 332092 - DNA, 617 bp, Homo sapiens
  misc_feature: GZ8MTXP01D05HJ.8.39.D06.1.454.CMB.2.raw
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
  modified_base (464)..(464): a, c, t, g, unknown or other
  misc_feature (464)..(464): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtgggctgagagtgaagtacgtccgtggggcctcgagtgaagtatttccngacgaaggcgtccggatacgaggttcaccgcgtctatattagtggctgcgacgacggcccctaggacgagggctaggagtggagtggggaanaacgtccgaaccccggaggtggagggtgtacgacgagaacggtacgcccgtaggtacggttcgagggcagacgtctacagtcgaccgagtacgacacggtccgacgacgctacgtgtactagtagnggtagagttggaggtacgaccgtaggtagtacggttacgaacggtaaccggtacggttaccgttaagtttaacgttaccgttggttacggttcggaaaggtaagttaccgggaaaggtacggggttacgacgttaacgttaacgttaaccggg

SEQ ID NO: 332093 - DNA, 566 bp, Homo sapiens
  misc_feature: GZ8MTXP01AGAN9.8.39.D06.1.454.CMB.2.raw
  modified_base (228)..(228): a, c, t, g, unknown or other
  misc_feature (228)..(228): n is a, c, g, or t
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctnagtgaagtatttcctgcaaggcgtccggatacaggttcacgcgtctatatatggctgcgacacggcccctggacgaagggcctgagtgggagtgggganaagtcgaacccccgnggtggaggtggtgacgagaagtacgcccaggtaggttcgagggcagagtctccagtcgaccgagtcgacacggtccgcgacgcacgttgtactagtagtggaagagtgaggagccgtggaagtacgttcggaacgaacgacgggttacccggttaattacgttacgtggttcgcgaaggtaaagtacggaaaggaaggggtagggactaacttaacgttaacgg

SEQ ID NO: 332094 - DNA, 515 bp, Homo sapiens
  misc_feature: GZ8MTXP01ASR3M.8.39.D06.1.454.CMB.2.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctgggggcctnagtgaagatttccngcaaggcgtcggatacaggttcaccgccgtctatattaatggctgcgacaggcccctggacaagggcctgagtggagtgggganaatcaaccccggagtggaggnggtgacaggngtaccgcccaggtaggttcgagggcagagtcnccatgaccagtcgaccacgtccgcgagcacgtgtctatagtggagagtggaggagcctgagtactgcgaacncggccgtattntacgtgttgcgagaatacggaagacggtggctaacgaataacgg

SEQ ID NO: 332095 - DNA, 639 bp, Homo sapiens
  misc_feature: GZ8MTXP01CK8K5.8.39.D06.1.454.CMB.2.raw
  modified_base (215)..(215): a, c, t, g, unknown or other
  misc_feature (215)..(215): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (420)..(420): a, c, t, g, unknown or other
  misc_feature (420)..(420): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggganacgccaccctctcctgcagggccagtgtaaccttttagtagttagttatttagctggtatcggacaaaacgtgccaggcctcccgactccttcttcgtttggnggtagcttacgngggccactgggaccacccccgagaccaggctacgacggtgggacagggtccggggtcgtaagggggactaacggtacctttctatttccnccaaccctatacccaaacgtacgaactcggaccaacggtccctaggaaacgtatagttgaccttaggtttactacgtgggtcagtctaaggttcttcggttacccggtcccgtaggtaccggttccgggaccgaaacggggtacccaagggtcgactaacgttaccgaaaccgtacgttggacggccttcgactaacacgttcttacgtccttcgtccc

SEQ ID NO: 332096 - DNA, 641 bp, Homo sapiens
  misc_feature: GZ8MTXP01BF1PQ.8.39.D06.1.454.CMB.2.raw
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtgggctgagatgaagagtccgtggggcctgagtgaagtatttccgagcgaacggcgtccggatacgacggtccaccgtccgtactattattatggctgcgacgacggccccgtaggaacgacgggcctggaggtggagtggggaanacgtccgaaccccgaggtaggaggtggngacgaggcgtacgcccgaggtacggtttcgaggggacaagcgtctaccagtcgaacccgaggttacgaaccgtaccggtccggaccgacgtacccgtacgttaccggttactaaggtagttaggggaaggtaaggttagggaagggttacgaccgttagggtaaacgtacggttacggaaccggaaccgtaccgggttccggttaaattcgttaacgtggttacgcggttaagaagtacggaaggtaaggcgaactaacttaagtaacgg

SEQ ID NO: 332097 - DNA, 567 bp, Homo sapiens
  misc_feature: GZ8MTXP01BA83Q.8.39.D06.1.454.CMB.2.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (522)..(522): a, c, t, g, unknown or other
  misc_feature (522)..(522): n is a, c, g, or t
  modified_base (546)..(546): a, c, t, g, unknown or other
  misc_feature (546)..(546): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccgaggtgcagctggtgcagtcgtggggctgagatgaagngtccgtgggcctgagtgaagtnttccngacgaaggccgtacggatacgngtccaccgctatatatagtgctgcgacncggccctaggacgagggcctgaggtggagtgggacaagccgaaccgaggtggaggtgngacagcgtacgccgagtacggtgacgggacagtacgtcctacacgtacggacctagtacgaccgtacgccgcgagccgtacgtgtacgtaataggtggaagagtggacggacgtaccgtaggaaccgtacgtacgaacggaacgtacggttacgtaattagttacgtgacgngttaacgaagtacggaagtacggngaacctaagttaacgtaacgg

SEQ ID NO: 332098 - DNA, 566 bp, Homo sapiens
  misc_feature: GZ8MTXP01D7O7A.8.39.D06.1.454.CMB.2.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
  modified_base (455)..(455): a, c, t, g, unknown or other
  misc_feature (455)..(455): n is a, c, g, or t
  modified_base (524)..(524): a, c, t, g, unknown or other
  misc_feature (524)..(524): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctaccaaccacccttgttctttgtctccgtgggggganacgccaccctctctgcngggccagtgtaactttagtagttagttattacgctggtatcggaacaaaactggccaggctccccgatccttnttcttggtggacgtcttacgagggccacgtcggaccacccgagacgaggatcgaggtggacagggtcggtcgtagggacngtacttcattcacacatacaacgngactgcaggcctaagaacattatcgatagtttacactggtangtactagtatcgttaccgtccggagtccgttcggaccgaaggcgaaggtggactacgttacgaaaccgngttagttcggctgaccaactacgtcttacgtcttcgtaaccc

SEQ ID NO: 332099 - DNA, 804 bp, Homo sapiens
  misc_feature: GZ8MTXP01A858P.8.39.D06.1.454.CMB.2.raw
  modified_base (219)..(219): a, c, t, g, unknown or other
  misc_feature (219)..(219): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtcctaccaaccaccctgttctttgtctccgtgggggganagccaccctctcctgcgagggccagtcgtaaccttttagtagttagttattagccgtggtatcggacaaaacgtggccagcctccccgactccttctttcgttggtggacgtcttacgacgggccacgtcggacccacccgagacgaggactcgaggtcggcgagggtccggggtcgtaacggggactaacggtacctttactaactttcctaccaacctactaacccaaacgaagtaccgtacgaccgtaacggtacccgtaaggtaaagtaattaacgtttacgaccgttaaacgttttaaccttacgttacggggttaacgtaacggtaacgttaacggtttaacgtttaccgggtttaaccccgggtttaccccggggttaacggggttaacccgggtttacccgggggaaacccggtaaaaccgggggttaaacccgggtaaaacggggttaccgggttaaaccgtaaaacgttaacccggaaaacccggtaacggttacggggttcgggttaaccgttaaccggacccttaaaccgtacgtttaccgttccggtttaacccgtttaaccgttaaccccg

SEQ ID NO: 332100 - DNA, 645 bp, Homo sapiens
  misc_feature: GZ8MTXP01BAAGM.8.39.D06.1.454.CMB.2.raw
  modified_base (212)..(212): a, c, t, g, unknown or other
  misc_feature (212)..(212): n is a, c, g, or t
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggaggtcttctgcttgctggctgtagttccaggtgctcactccaggtgcagctggtgcagtcgtggggctgagatgaagngtccgtgggcctgagtgaagtattccgtgacgaacggcgtcggatacgaggttcaccgtcgtctatattagtgctgcgacacggccccgtaggacgacgggcctgagtggagtggganaacgtccgaaacccccggnggtgggaggtggtagaacgtaaggaacgtaccgacccgtagggtacgggtttacggacggggacgaaggtacgttcgtaccgaagtcggaacccgtaggtacgaacccgtaccggtcccggacggtacgaccgtacgttcgtactagtaggtaggaagtagtaggacggacgaccgtagtacgtacgttcgaaccgaaccgtacccgttacccgttaagttacgttaccgtaggacgacgaaacgtaacggtaacggaaagggtacggtacgttaactaacgttaacgtaaccggg

SEQ ID NO: 332101 - DNA, 686 bp, Homo sapiens
  misc_feature: GZ8MTXP01A63AP.8.39.D06.1.454.CMB.2.raw
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatggaagacgtccgtgggggcctcgagtagaagtatttcctgacgaaggcgtccggatacgaggtccaccgcgtactaattattatggctgccgacgacggcccctaggacgaacgggcctggaggtgggagtgggggaanaacgtacggaaccccggnggtgggagggtgtgacgaaggcgtaccgcccgtaggtacgggttacgacgggacgacggtacgtcctaccgagtacgaacccgtaggtaccgaccgtaaccggtcccggacgacgaccgtaacgttcgttacgttaagtaggttgggaagtaggtcggaacggttaccgaccggttaggaacgtaccggttacggaaccggtaaccgtacgggttaccgtttaattacgttaccggttaggaccggttacggttaaacgggtaagttacgggaaaggggtaacgggtcggttaacctaacggttaaacgttaacccgggg

SEQ ID NO: 332102 - DNA, 593 bp, Homo sapiens
  misc_feature: GZ8MTXP01BGJLC.8.39.D06.1.454.CMB.2.raw
  modified_base (336)..(336): a, c, t, g, unknown or other
  misc_feature (336)..(336): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagacgtccgtggggcctgagtagaagtatttcctgacgaaggcgtccggatacgaggttcaccgtcgtctatattagtgctgcgacgacggcccctggacgacgggcgtgaggtggagtgggganaacgtaccgaaccccggaggtagggaggtcggtgaacgagaacggtaccgacccgagggtaggttacgaggggacagtacgtcgtacgagtcgaaccaggtacgaccgtaccggtacccggacgacgaccacgttacggtacttaagtagtagggagttagaggacggagccgtagacgtacgttcgaacgaacgacggttacgtattagtacgtgttagcgagaagtacggaagaggtagactaagaacgtaacgg

SEQ ID NO: 332103 - DNA, 591 bp, Homo sapiens
  misc_feature: GZ8MTXP01B3UDB.8.39.D06.1.454.CMB.2.raw
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccgaggtgcagctggtgcagtcgtggggctgagatgaagngtccgtggggcctgagtgaagtnttccngcaaggcgtccggatacaggttcaccgccgtctatattaatggctgcgacnggcccctggacagggcctggagtggagtggggagatccgaaccccgaggtggaggtggtgacgacgnggtaccgcccgaaggtacgggtttcgacggggtacgaggtacgtctacccagtcgaaccgagtacgaccgaccgtccggcggagcaactgttacgtatagtaggagtagtggaggagaccgtggacgtacgttcggacggtaacgcggttaccgtaattacgttacgtgttaggcgttaagtaagtaccggaaaggtaaggggtacgaccgttaacgaaacgttaaccgg

SEQ ID NO: 332104 - DNA, 618 bp, Homo sapiens
  misc_feature: GZ8MTXP01CGSWX.8.39.D06.1.454.CMB.2.raw
  modified_base (241)..(241): a, c, t, g, unknown or other
  misc_feature (241)..(241): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggaggtcttctgcttgctggctgtagttccaggtgctcacctcccgaggtgcagctggtgcagtcgtgggctagagagtagaagtcgtccgtgggcctagagtgaagtntttccagacgaaggcgtacgatacgagttccaccgtcgtactattacttagttgctgacgacacggccccgtaggacgacggcctgggaggcggtagtagggaatacgtaccgaaccccggaggtgggaggttgacgaacgagtaacggaccgaccgtagggttacggttacggacgggtacgaagtacgtcctacgagtcgaaccgtagtacgaccgtacggtccgacgacgacgtacgttgtaacggttataagggtagaagtagaggaggaccgttacgaggtaacgtacgtacgacgaacgtacggttacttattcgttacgggttacgacgaagtaacgtagaaggtggacgttactaacgaagttaaccgg

SEQ ID NO: 332105 - DNA, 716 bp, Homo sapiens
  misc_feature: GZ8MTXP01CA079.8.39.D06.1.454.CMB.2.raw
  modified_base (221)..(221): a, c, t, g, unknown or other
  misc_feature (221)..(221): n is a, c, g, or t
tcagctcgcgtgtccacgaccggtgctcgatttagtgacatctcgcagttctttgggggagagctctggagaagagctgctcagttaggacccagagggaaccatggaaagcccagcgcagcttctcttcctcctgctactctggctcccagagacgaccggagagattgtattgacgcagtcctccaaccacccttgttctttgtctccggtgggggganacgcccaccctctcctgcgagggccagtgtaactttagtagttagttattagctggtatcggacaaaacgtggccaggcctccccgactccttcttcgttggtggatcttacgacgggccacgtcgggcccaccccgagacgaggactacgaggtggcgagggtcggggtcgtacggggaactaaggtacttctaactttccaccacctactaccaaacacgactgacacgtctaagaagtattagtagcttaacgtttactaacgttcggtaacacggtaccttaggttaaccgttccgggtttaaccccggtttacccggggttacggggttaacccggtttacccggggaacccgggttaaaccgggggaacccggttaaagggggtcggttaaccgtaaacgttacccggtaaaacccgtacggttacgggttccggacgttaacggaccctaacccgtgttccttcggtttaacccttaacttaaccccg

SEQ ID NO: 332106 - DNA, 628 bp, Homo sapiens
  misc_feature: GZ8MTXP01DNAWR.8.39.D06.1.454.CMB.2.raw
  modified_base (220)..(220): a, c, t, g, unknown or other
  misc_feature (220)..(220): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtcctccaaccaccctgttctttgtcctccgtggggggganacgccaccctctcctgcgagggccagttgtaacctttttagtagttagttatttagcctggtatcggacaaaacctggccaggcctccccgactcctcttgtttggtgagtcttacgagggcccacgtcggccaccccgagaccaggatcgagtggcgaggcggggtcgtacggggaacaaggtacctttcacgtttcctaccaaccgataccaaactagtacctggctagcccttaggaaagtattaagttgacttaaagtttactaccgttggtcaagtccgtaagttacttcggttaccggtccccggtagggtaccgttcgggaccgtaacggggacctaaagggtcgacaacgttacgaaaccgtattggcggctgaccaacgtactcttcgtcttcgtaacc

SEQ ID NO: 332107 - DNA, 645 bp, Homo sapiens
  misc_feature: GZ8MTXP01DCYOA.8.39.D06.1.454.CMB.2.raw
  modified_base (244)..(244): a, c, t, g, unknown or other
  misc_feature (244)..(244): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggaggtcttctgcttgctggctgtagttccaggtgctcacctcccgaggtgcagctggtgcagtcgtggggctgagagtgaagcgtccgtgggcctcgagtgaagtattccngacgacggtcgtacgatacgagtccaccgtctatatattagtgctgcgacgacggccccgtaggacgaggccgtaggacggtagggagtagggacgaacgtaccgaaccccggtagggtacgggtagggtggtacgaacgaggtaacggtacccgacccggtaagggtacggttacgagggacgaggtacgtcctacacgtacgaaccgacggtacgaaccgtaccggtccgacgtacgcctacgttcgttacgtaagtaggtagggagtaaggtggacggacgtccgtagtacgtacgttacggacgtaaccgtcgggttacttacgttacgttacgtgttacgacggaagtaacggttaacggaacggtaacggtcggaactaacgaacgttaaccggg

SEQ ID NO: 332108 - DNA, 618 bp, Homo sapiens
  misc_feature: GZ8MTXP01C1CPK.8.39.D06.1.454.CMB.2.raw
  modified_base (228)..(228): a, c, t, g, unknown or other
  misc_feature (228)..(228): n is a, c, g, or t
  modified_base (328)..(328): a, c, t, g, unknown or other
  misc_feature (328)..(328): n is a, c, g, or t
  modified_base (341)..(341): a, c, t, g, unknown or other
  misc_feature (341)..(341): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggaggtcttctgcttgctggctgtagttccaggtgctcactcccaggtgcagctggtgcagtcgtggggctgagatagaagagtccgtggggcctnagtgaagatttccagcgaaggcgtacggatacgaggttccaccgtcgtctattacttaagtgctgcgacgacggcccctggaacgtagggcctaggaggnggagtaggggaanaacgtaccgaaaccccggtaggtacgggaggtgggtcgaacgaagtcggtaccgacccgaagggtacgggtttacgaggggacaggtacgtacctaccgagtacgacaggtacgaccgtaccgtccggacgacgcgtaaccgtgttacgtaagtagtaggaagtagtggaacgtcgaccgttagacgtacgtcgaacgtaacgcgacgttattagttacgtcggttagaccggagtaagtacggaaaggtaggtacggactaacgaacgttaacggg

SEQ ID NO: 332109 - DNA, 525 bp, Homo sapiens
  misc_feature: GZ8MTXP02JMGHI.8.39.D06.1.454.CMB.2.raw
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagattcctgcaaggcgtccggatacaggttcaccgccgtctatataatggctgcgacaggcccctggacaagggcctgagtggatgggganaagtcaacccccgagtggaggtggtgcagngtacgccagagttcagggcagagtctccatgaccagtgacacgtccgcgagcactgtctatatggagatgagagctgagactgacgacacggccgtaagtacttaacgtgttagacggaagaaagttaccggaaaaggtaaacggggtagggtactaaccggtaaataaccgg

SEQ ID NO: 332110 - DNA, 530 bp, Homo sapiens
  misc_feature: GZ8MTXP02JMXGN.8.39.D06.1.454.CMB.2.raw
  modified_base (240)..(240): a, c, t, g, unknown or other
  misc_feature (240)..(240): n is a, c, g, or t
  modified_base (326)..(326): a, c, t, g, unknown or other
  misc_feature (326)..(326): n is a, c, g, or t
  modified_base (356)..(356): a, c, t, g, unknown or other
  misc_feature (356)..(356): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttccngcaaggcgtccggatacgaggttcaccgccgtctatattaattggctgcgacaggcccctggacaagggcctgagtggatgggganaatcgaaccccgagtggaggtggtgcgagngtacgcccgaggtaggttcgagggcagagtctccatgaccagtgacgacgtccgcgagcactgtctatagtggagatgaggacgccgtagagtactgaacgacgacggtaccgtatacgttacgtgtacgacgaagaacgtacggaaaggaagggtggactaacgaataaccgg

SEQ ID NO: 332111 - DNA, 532 bp, Homo sapiens
  misc_feature: GZ8MTXP02GWOC3.8.39.D06.1.454.CMB.2.raw
  modified_base (353)..(353): a, c, t, g, unknown or other
  misc_feature (353)..(353): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaatggctgcgacaggcccctggacaagggcctgagtggatggggagaatcgaaccccgagtggaggtggtgcagngtacgccgagagttcagggcagagtctccatgaccagtgacacgtcgcgagcactgtctatatggagagtagaggagccgtgacgtacgttagacgtaacgacggaccgtaattattaacgtgtacgacgtaagaacgtacggaaacggtaagggtaggaccgtaacgaacgtaaccgg

SEQ ID NO: 332112 - DNA, 542 bp, Homo sapiens
  misc_feature: GZ8MTXP02HXU1G.8.39.D06.1.454.CMB.2.raw
  modified_base (215)..(215): a, c, t, g, unknown or other
  misc_feature (215)..(215): n is a, c, g, or t
  modified_base (376)..(376): a, c, t, g, unknown or other
  misc_feature (376)..(376): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttgagtagttatttagcctggtatcggacaaaacctggccaggctccccgactccctctttctttggtgagcttacgagggccactggccaccccagaccaggatcagtgcaggcggggtctggggacngtacttcattctcacatacaaacagactgcagcctagaagatattgactagtttactacgtgtacagcagtatcgttacgcccgtgacgttcggacgtaagggacctaaggtgacaactacaaaccgtactgtcggactggcctaaccgactcgtcgttcttctac

SEQ ID NO: 332113 - DNA, 761 bp, Homo sapiens
  misc_feature: GZ8MTXP02IZST5.8.39.D06.1.454.CMB.2.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctaccaaccaccctgttctttgtctccggtggggganacgccaccctctctgcagggccagtntaactttagtagtagttattagctgtatcggacaaaacgtgccaggcctccccgactcctctttcttgggtgacgtcttacgcgggtccacgtcggaccaccccgagacgaggactcgagtcggacgagggccggggttctaggggactacgggtacctttcgtaacttttccaccctaacctaactacccaaaacgacggtaaaccttcgggaaccaaacggtcccgtaaagggtaaacgtaaatttagttacggtaccttaaggtttttaaacccagtttacgttaaccgaaggttacctaagggtttaacgtttaccggtttaaccccggttccccgggttacggggtaaacccggtttcccggggaaaccgggtaaaacgggggaacccgttaaacggggtacgggtaaacccaaacggttaaacccgaaaacccggtaaacgttcggttcgggaccttaacggtaacccgaaccttacgttaccggtttacgtttccgttaactttacccgg

SEQ ID NO: 332114 - DNA, 560 bp, Homo sapiens
  misc_feature: GZ8MTXP02HRJY6.8.39.D06.1.454.CMB.2.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgttctttgtctccgtgggggganacgccaccctntcctgcagggccagtgtaaccttttagagtagtttattagcctggtatcggacaaaacctggccaggctccccgatcctcttcttggtgagcttacgaggccactggccacccagacaggatcagtgcagcggtntgggacngacttcattctcacatcaaactagactgcagcctagaacgatatgactagttactactgtacagcagtatcgtacgtcccgtagtacgttcgaccgaaagggaccaaggtcggacaaacgtaccgaaaaccgtaacgtcggttacggctaacggaccaaccgtacttccgttcgttactttactaacccg

SEQ ID NO: 332115 - DNA, 577 bp, Homo sapiens
  misc_feature: GZ8MTXP02GFAO4.8.39.D06.1.454.CMB.2.raw
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctcgagtgaagtatttccngcgaaggcgtccggatacgaggtcaccgccgtctatattaatggctgcgacncggcccctggacgaggctgagtggagnggganactacgacccgngtggaggtggngcgagacgtaccgaccgaggtagttcgagggacagacgtctaccagtacgaccgagtacgaccgtaccggtccgacgacgctacgttcgtactaagtagtagggaagtagtaggaacggtacgccgtaggaacgtacgtacgaaccgtaacgaccggtaccgttagtaacgttacgtggtacgagaagtaacgtaggaaaggtacgggacgactaaacgacgtacgg

SEQ ID NO: 332116 - DNA, 530 bp, Homo sapiens
  misc_feature: GZ8MTXP02IWBJD.8.39.D06.1.454.CMB.2.raw
  modified_base (241)..(241): a, c, t, g, unknown or other
  misc_feature (241)..(241): n is a, c, g, or t
  modified_base (328)..(328): a, c, t, g, unknown or other
  misc_feature (328)..(328): n is a, c, g, or t
  modified_base (515)..(515): a, c, t, g, unknown or other
  misc_feature (515)..(515): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctcagtgaagatttccngcaaggcgtccggatacaggttcaccgcgtctatattaatgctgcgacacggcccctggacgaagggcctaggagtggagtgggganaagtccgaaccccgaggtggaggtggtgacgagagtaccgccgaggtagttcgagggcagagtctcatcgaccagtgacacgtcgcgacgcacgtgtactagtatggagagtgaggacgcgtagacgtactagacgacgacggtaccgtatagttacgtcgtacgacgaagtaagcggaaagtaggngtactacaactacgg

SEQ ID NO: 332117 - DNA, 502 bp, Homo sapiens
  misc_feature: GZ8MTXP02GHYZU.8.39.D06.1.454.CMB.2.raw
  modified_base (353)..(353): a, c, t, g, unknown or other
  misc_feature (353)..(353): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaaccccgagtggaggtggtgcagngtacgccagagtttcaggggcagagtctccgatgaccagtgacacgtcgcgagcactgtctatatggagagtgaggagccgtagagacttgaacgacacgggccgtatattactgtagcgagaatcgaagaacggtggactacaatacg

SEQ ID NO: 332118 - DNA, 554 bp, Homo sapiens
  misc_feature: GZ8MTXP02H1CI1.8.39.D06.1.454.CMB.2.raw
  modified_base (216)..(216): a, c, t, g, unknown or other
  misc_feature (216)..(216): n is a, c, g, or t
  modified_base (327)..(327): a, c, t, g, unknown or other
  misc_feature (327)..(327): n is a, c, g, or t
  modified_base (381)..(381): a, c, t, g, unknown or other
  misc_feature (381)..(381): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaaccttttagagtagttattagcctggtatcggacaaaacctggaccaggctccccgactcctcttctttggtggagcttacgnggccacgtggcaccccagaccaggatcgagtggccaggcgggtcgtaggggacngacttcacttcctacaccatcaaacagactgcacgctagaagatatgactagtttactatgtacagactagtatcgttaccgtcccggtggacgttcggacgaagggaaccgtaaggaggtacaaatccgaaaacgtactaggtcgctcgcactactcgtcgttcctactacc

SEQ ID NO: 332119 - DNA, 653 bp, Homo sapiens
  misc_feature: GZ8MTXP02JKX6J.8.39.D06.1.454.CMB.2.raw
  modified_base (216)..(216): a, c, t, g, unknown or other
  misc_feature (216)..(216): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
tcagctcgcgtgtccacgaccggtgctcgatttagtgacatctcgcagttctttgggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggganagccaccctctcctgcagggccagtgtaaccttttagagttagttattagcctggtatcggacaaaactgccagcctccccgactcctcttcttggtgagcttacgagggccacgtggccacccagacaggatcngtgcagcgggtcgtggacngtacttcgattcctacaaccatacccaaacagacctcgacgacgaccctagaaacgtattaagtttcgacgttagttttaacctaaacgttggtacctaagtacctaaggtttaactacgtttaaccaccgttcccccgggtagggtaaccggtttccgggaaccccgaaaaggggtaccccgtaaggggttaccgaccgtaaacgtacccgtaaaaccgaaaccgttggtaccggtcgttaccggacctaacccgtacttccgttacggttaccgtttaccc

SEQ ID NO: 332120 - DNA, 750 bp, Homo sapiens
  misc_feature: GZ8MTXP02GM1L7.8.39.D06.1.454.CMB.2.raw
  modified_base (215)..(215): a, c, t, g, unknown or other
  misc_feature (215)..(215): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggganacgcccaccctctcctgcgagggccagtacgtaaccttttagtagttagttattagcctggtatcggacaaaacctggccaggcctccccgactcctctttcttggtggagtcttacgacgggccacgtcgggccaccccgagaacgaggactcgaggtcggcgaggtcggggtacgtcggggaactacggtaccttacacgtttcctaccaacctaacttaccaaaaccgtacgtaaaccgttcgaaccgtaacggtacccttaacggaaacggtaatttaaacgttcgaaccgtttaacggttttaacttaaaccgttgtacccgtaagtacgtaaggtttaacgttaccggtttaaccccggttcccccgggttagggttaacccggtttaccgggaacccggtaaaacgggggtaaccgtaaacggggttacggaccgtaaacgttaacccggaaaccgtaaacggtcggtacggtaccgtaacggaccctaaaccgtacttaccgttcggttacctttacgtttaccccg

SEQ ID NO: 332121 - DNA, 534 bp, Homo sapiens
  misc_feature: GZ8MTXP02G1QO3.8.39.D06.1.454.CMB.2.raw
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (427)..(427): a, c, t, g, unknown or other
  misc_feature (427)..(427): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctnagtgaagattccngcaaggcgtcggatacaggtcaccgccgtctatattaatggctgcgacacggcccctggacaagggcctggagtggagtggggagaagtcgaacccccgagtggaggtggtgcgagcgtacgccaggtagttcgagggcagagtctcagtacgacagtgacacgtccgacgagcactgtactagtagnggtagagtgaggacgccgtaggagacgttgaacgtacgaccggacgtactacgttacgtgtacgcgaagaagtacggaaacgtaggtacggactaacgaacgtacgg

SEQ ID NO: 332122 - DNA, 587 bp, Homo sapiens
  misc_feature: GZ8MTXP02GITTT.8.39.D06.1.454.CMB.2.raw
  modified_base (215)..(215): a, c, t, g, unknown or other
  misc_feature (215)..(215): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggganacgccaccctctcctgcgagggccagtgtaaccttttagagttagttatttagcctggtatcggacaaaaccgtggccaggcctccccgactcctcttctttgggtgagtcttacgagggccacgtggccaccccgagaccaggatcagtggcaggtcgggtcgtggggacaggtaccttcatttcctcaacatacaaacgagaacctgacgagacctagaaagtattattgactagtttactacttgtcagtctagttatcgttaccgtcccggtaggtaccgttcggacgaacgggaccgtaggtcggactaacgtaccgaaccgtacgtcggtacggctcgccgaacctcgtcttcgtccttacttccg

SEQ ID NO: 332123 - DNA, 532 bp, Homo sapiens
  misc_feature: GZ8MTXP02F1OS2.8.39.D06.1.454.CMB.2.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
  modified_base (514)..(514): a, c, t, g, unknown or other
  misc_feature (514)..(514): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctnagtgaagtatttccngcaaggcgtccggatacaggttcaccgccgtctatattaattgctgcgacacggcccctggacaagggcctgagtggagtggganaatcgaaccccgagtggaggtggtgacgagagtaccgccaggtagttcgaggggcagagtctaccatcgacagtcgacacgtcgcgagcacgtgtctagtagtggagagtagaggacgcgtagacgtactgaacgacgacggtacgtatacgttactcgtagcgaagaagtacgaaaggtaacggngtactaacgaagtaccgg

SEQ ID NO: 332124 - DNA, 503 bp, Homo sapiens
  misc_feature: GZ8MTXP02FW5GT.8.39.D06.1.454.CMB.2.raw
  modified_base (240)..(240): a, c, t, g, unknown or other
  misc_feature (240)..(240): n is a, c, g, or t
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (470)..(470): a, c, t, g, unknown or other
  misc_feature (470)..(470): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttccngcaaggcgtccggatacaggttcaccgccgtctatattaattggctgcgacaggcccctggacaagggcctgagtggatgggganaagtcaacccccgagtggaggtggtgcagngtaccgcccgagaggtttcgagggcagagtctccatgaccagtgacacgtccgcgagcactgtctatagtggagatgaggagccgtgagactgacgacgacggccgtatattacngtgcgagaagtcgaagaaggtggactacatacg

SEQ ID NO: 332125 - DNA, 636 bp, Homo sapiens
  misc_feature: GZ8MTXP02I7GSO.8.39.D06.1.454.CMB.2.raw
  modified_base (248)..(248): a, c, t, g, unknown or other
  misc_feature (248)..(248): n is a, c, g, or t
  modified_base (370)..(370): a, c, t, g, unknown or other
  misc_feature (370)..(370): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggaggtcttctgcttgctggctgtagttccaggtgctcactcccgaggtgcagcgtggtgctagtcgtggggctgagagtagaagacgtccgtgggcctgagtagagtacttccgngacgaacggcgtacggtatacgtacggttccaccgtccgtactaacttaagttaagttggctcggacgaccgaccggtccccgtaggacgaacgggccgtaggacggtgggaggtagggganaacgtaccgaacccggtaggtagggtagggtggtcgacgagtaccgggtaccgacccggtaggtacggttacggacgggactaggtacgtcctaccgagtacgacgtacgtacggacccgtacggtccgacgacgactacgtgtactagttagaggagagtaggacggacgacgtagacgtacgtacgaccgtacgacggtacttacgtagtacgtgtacgaagtagaagtaacggaaggtacggtaggactaacgtacgtaacgg

SEQ ID NO: 332126 - DNA, 551 bp, Homo sapiens
  misc_feature: GZ8MTXP02G4OWU.8.39.D06.1.454.CMB.2.raw
  modified_base (358)..(358): a, c, t, g, unknown or other
  misc_feature (358)..(358): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtctggggcctcagtgaagatttcctgcaaggcgtccggatacaggttcaccgccgtctatattaattggctgcgacaggcccctggacaagggcctggagtggagtggggagaatcaacccccgagtcggaggtggtgacgagngtacgcccgagaggtttcgaggggcaggagtctccatgaccagtgacgacgtccgcgacgcactgtctagtatggagatggaggagcgtgagcttgacgacgacggaccgtattacgttacgtagttacgacgtaaggaaacgttacggaaaacggtaaagggtacggtaccgtaacgtaaacgttaacccgg

SEQ ID NO: 332127 - DNA, 624 bp, Homo sapiens
  misc_feature: GZ8MTXP02F252O.8.39.D06.1.454.CMB.2.raw
  modified_base (216)..(216): a, c, t, g, unknown or other
  misc_feature (216)..(216): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgtaacctttagtagtagttattagctggtatcggacaaaactggccagcctccccgactcctcttcttggtgagcttacaggccactggcacccagacaggatcacgtggcaggcggtcgtggacngactcatctcacatacaacanactgacagctagaacgattagtgactagtttaaactacgtacgtacgagtacgtaacgttaagttacgtttaacccggttccccgggttaggggttaacccggtttaccggacccggtaaacggggaaaccggtaacggggttacggacgtaaaccgtaaccgtaaaccgtaaaccgttacggtaacggtcgtaacggacctaaccgacgttaccttcggttctaccgtttaaccc

SEQ ID NO: 332128 - DNA, 567 bp, Homo sapiens
  misc_feature: GZ8MTXP02JV1JL.8.39.D06.1.454.CMB.2.raw
  modified_base (217)..(217): a, c, t, g, unknown or other
  misc_feature (217)..(217): n is a, c, g, or t
  modified_base (455)..(455): a, c, t, g, unknown or other
  misc_feature (455)..(455): n is a, c, g, or t
tcagctcgcgtgtccacgaccggtgctcgatttagtgacatctcgcagttctttgggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganacgccaccctctcctgcagggccagtgtaaccttttagtagtagttattagcctggtatcggacaaaacctggccaggctccccgactcctctttcttggtggagtcttacgagggccactgggccaccccagaccgaggactcaggtggcgaggcggggtctggggacaggacttcgattcactaccatcaaacagactgcagcctagacgatatgactagtttactacgtgtcagntagttagtcgttaccgtcccggtaggtacgttccggacgaacggacgtaacgggtcggactaacgaccgaaacgtacgtcgtcgctcgactaccactctcgtacttctaccg

SEQ ID NO: 332129 - DNA, 577 bp, Homo sapiens
  misc_feature: GZ8MTXP02ISXOC.8.39.D06.1.454.CMB.2.raw
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctgagtgaagatttcctgcaaggcgtccggatacgaggttcaccgcgtatatattaatgctgcgacaggcccctggacaagggctcgagtggagtggggagaaagtccaacccccggaggtacgggaggtgggtacgaccgagacggttaccgacccgaaggtacgggtttacgaggggccaggacgtctaccgatacgacccaagtcgacaaccggtccgacgacgaccaacgtcgtacttagtagttgggagagtaggaggacgtccgtagacgtacgttgacgtacgacggcgtactattacgtgtacgacgaagtaagacggtaaggaggtacggactaacgaactacgg

SEQ ID NO: 332130 - DNA, 608 bp, Homo sapiens
  misc_feature: GZ8MTXP02GTA4S.8.39.D06.1.454.CMB.2.raw
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
tcagctcgcgtgtccacgaccggtgctcgatttagtgacatctcgcagttctttggggagcatcatccaacaaacacatcccttctctacagaagcctctgagaggaaagttcctcaccatggactggacctggagggtcttctgcttgctggctgtagttccaggtgctcactcccaggtgcagctggtgcagtcgtggggctgagatagaagngtccgtggggcctgagtgaagtactttccgngacgaaggcgtccggatacgacggttccaccgccgtactatattaagttggctgcgacgacggccccgtaggacgaacgggcctggaggtaggaggtaggggaagaacgtaccgaaacccccggtaggtagggaggtggtgacgaggtacgtaccgaccgaggtacgttcgagggtcaggacgtcctaccagtacgaccgtagtacgaccgtccggaccgcgacgctaaccgtgttactagtagtagggaagagtaggaaggtacgtcgagacgtacgtacgaacgacgacggtactaagtacgtagtgacgtacgaagtaacgtaggaaaggtacggtcgaactaacgtaacgtaaccggg

SEQ ID NO: 332131 - DNA, 553 bp, Homo sapiens
  misc_feature: GZ8MTXP02GJQG6.8.39.D06.1.454.CMB.2.raw
  modified_base (215)..(215): a, c, t, g, unknown or other
  misc_feature (215)..(215): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgctccgtgggggganagcccacctctcctgcagggccagtgaaccttttagagttagttattagcctggtatcggacaaaacctggccaggcctccccgactcctcttctttggtggagtcttacgagggccacgtcggccaccccagaccaggatcagtggcagcggtctgggacngctnattcncacatcaacanactgacagccctagaagtatattgactagtttactactgtacagacaggtatcgttacgtcccgtaggtacgttcggacgaacgggaccaagggtcggacaaacgtacaaaccgacgtaggtcgcgtaacgaccacacgtcctcgtcttactaccg

SEQ ID NO: 332132 - DNA, 554 bp, Homo sapiens
  misc_feature: GZ8MTXP02I292E.8.39.D06.1.454.CMB.2.raw
  modified_base (242)..(242): a, c, t, g, unknown or other
  misc_feature (242)..(242): n is a, c, g, or t
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtccgtggggcctcagtgaagtatttccngcaaggcgtccggatacaggttcaccgccgtctatattaatggctgcgacacggccccctggacaagggcctggacgtggagtgggganaacgtccgaaccccgagtggaggtggtgcgagngtacnccgaggtacgttcagggcagagtctccatgaccagtagaccacgtccgcgacgcactgtctagtgtaggagaagtggaggagtccgtagacgtagttagacgtacggacgaccggtccgtaattactttacgtggttacgacggtaagtaagtacggaaaaggtaggtacggactaaacgtaacg

SEQ ID NO: 332133 - DNA, 665 bp, Homo sapiens
  misc_feature: GZ8MTXP02G0WL1.8.39.D06.1.454.CMB.2.raw
  modified_base (247)..(247): a, c, t, g, unknown or other
  misc_feature (247)..(247): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatagaagagtccgtggggcctacgagtagaagtatttccngacgaaggccgtaccggatacgtaggttccaccgccgtactaatattaagttggctgcgacgacggccccgtaggacgaacgggcctaggaggtgggagtaggggaacgaacgtaccgaaccccggagggtacggggtagggtagggtcggacgtaagggaccggtaacccgacccggtaagggttaacggggtttcggaaggggtcgaaggtacggtctacccgtagtcgaaaccgaggtacgaacccgccgtcccgacgacgcctaacgtcgttactagtagtgggagaggtaggaggaggccgtagacgtacgtacggaacgtacgaccgggtacttaacgttacgtttacggtggtacgaacggtaagtaacgtacgggtaaaaggtaggtcggaacgtaacgtaacgtaccgg

SEQ ID NO: 332134 - DNA, 615 bp, Homo sapiens
  misc_feature: GZ8MTXP02GI6N1.8.39.D06.1.454.CMB.2.raw
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagngtccgtggggcctcagtgaagatttccngcaaggcgtccggatacaggttcaccgccgtctatattaatgctgcgacacggcccctggaccgaagggcctggaggtgggagtggggagaagtccgaacccccggaggtggaggtgggtgacgaggacgtaccgcccgaaggtaggtttacgaggggctaagggacgttcctaccctagtcgacccgtagtacgaaccgtaccggtcccgaccggagccgaacttcgggtaccttaagtagttgggaaggtaagtaggaagggacgtccgtaggaacgtacgttacggacgaaccgacggtaccgtaattacgttacgtaggttcgacgtaagaacgtacgaaaggtaacgggtagactaacgtaacgtacgg

SEQ ID NO: 332135 - DNA, 569 bp, Homo sapiens
  misc_feature: GZ8MTXP02IPQ15.8.39.D06.1.454.CMB.2.raw
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
  modified_base (462)..(462): a, c, t, g, unknown or other
  misc_feature (462)..(462): n is a, c, g, or t
  modified_base (509)..(509): a, c, t, g, unknown or other
  misc_feature (509)..(509): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactccaggtgcagctggtgcagtctggggctgagatgaagagtccgtggggcctcagtgaagatttcctgcaaggcgtcggatacnggttcaccgccgtctatattaatggctgcgacncggcccctggacaagggcctgagtggagtgggganaatccgaaccccgagtggaggtggtgcgagcgtacgcccaggtagttcgagggcaggagtctccgatacgacctagtacgaccgtacggtccgacgacgcaacgtcgttactagttagtgggacgtagtcggggacnccgtgacgacgttaggacgacgtacggaccgttaatacgtttaacgngttcgacgaagtaagtaacggaaaggtaacggtacggaacgtaactaacgtacgtaacgg

SEQ ID NO: 332136 - DNA, 615 bp, Homo sapiens
  misc_feature: GZ8MTXP02FZ0I8.8.39.D06.1.454.CMB.2.raw
  modified_base (335)..(335): a, c, t, g, unknown or other
  misc_feature (335)..(335): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctcgagtgaagtatttcctgcgaaggcgtccggatacgaggttcaccgccgtctatattatgctgcgacacggccccgtggacaacgggcctggacgtgggagtgggganaaagtccgaaccccgaggtgggagggtggtgacgagcggtaccgcccgtaggtacggttcgagggcagtacgtctccagtcgaccagtcgacgaccgtccgcgacgcctacgtgtacctagtagtaggagtagtacggaggacgccgttaggacgtacgttacggaaccggaaccgtaccgggtacccgttaagttaacgttaacgttcgtacggacggtaaacggtaaacgtaacggaaaaggtaacgggtacggtaacgtaaacgaacgttaaccggg

SEQ ID NO: 332137 - DNA, 543 bp, Homo sapiens
  misc_feature: GZ8MTXP02JUKR1.8.39.D06.1.454.CMB.2.raw
  modified_base (215)..(215): a, c, t, g, unknown or other
  misc_feature (215)..(215): n is a, c, g, or t
  modified_base (533)..(533): a, c, t, g, unknown or other
  misc_feature (533)..(533): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggganagccaccctctcctgcagggccagtgtaaccttttagtagttagttatttagcctggtatcggacaaaaacctggaccaggcctccccgactcctctttcgtttggtggagtcttacgcgggccactcgggccaccccgagaccaggatcgagtggcaggcggggtctcggggacaggtacttctaactttccacaacctatacaaacaagcctgacagccctagaagataagttgactagtttaccatgtcagctagtactgtacgccgtgacgtcgacgagacaggtgacatcaacgactgcgctgcaccgatcgngtactcgtac

SEQ ID NO: 332138 - DNA, 663 bp, Homo sapiens
  misc_feature: GZ8MTXP02ICOCX.8.39.D06.1.454.CMB.2.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcacctcccaggtgcagctggtgcagtcgtggggctgagatagaagtacgtccgtggggcctcgagtagaagtatttccngcaaggcgtccggatacgagttcaccgcgtactatattagtggctgcgacncggcccgtggacgaacggctggagtggagtagggganatacgaccccgaggtggaggtggtagcgagacggtaccgacccgtaagggttacgttacgacgggggcaacggtaacgtttccgcccgtaagtaccgaacccgtagtacgaaccgtaccggtacccgacggacgcctaaacgtgttaccgtaagttagagggtaagacgtaggaacggcgtaccgtaggtacgtacgttacgggaacccgtacgtaccgggttaaccgttattaacgttaccgtagggtaccggtaaccgaaaggtaaaacggttaaccggaaaagggtacggttaggaaccccgtttaagaacggttaaaccggg

SEQ ID NO: 332139 - DNA, 585 bp, Homo sapiens
  misc_feature: GZ8MTXP02G6AU4.8.39.D06.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (335)..(335): a, c, t, g, unknown or other
  misc_feature (335)..(335): n is a, c, g, or t
  modified_base (566)..(566): a, c, t, g, unknown or other
  misc_feature (566)..(566): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactccaggtgcagctggtgcagtcgtggggctgagatgaagagtccgtggggcctgagtgaagtnttccgngcaaggcgtccggatacgaggtcaccgccgtctatattaagtggctgcgacgacggccctaggacgaaggcctaggaggtggagtaggggaanaacgtacgaaccccggtaggtagggaggtggtgacgaaggtacgtaccgaccgaggtacggtttcgaacgggtcaaggacgtctaccgagtacgacgagtcgaccgaccgtcgacgacgactacgtgtactagttagaggtagagtggaaggagaccgtagacgtacgtaggaacgtacgacggtaccgtaatacgttagcgtagacgaagtaagtacggaaaggtacggngtactaacgaactaaccgg

SEQ ID NO: 332140 - DNA, 630 bp, Homo sapiens
  misc_feature: GZ8MTXP02GAMLM.8.39.D06.1.454.CMB.2.raw
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtggggcctcagtgaagtatttctgcaaggcgtccggatacnggtcaccgcgtntatatatgntgcgacncggccctggacgaagggcctggaggtggagtagggganaaagtccaaccccggagtaggggacggtggtgacgaggcggtaccgcccgaggtagggttcgagggcagtacgtctccagtcgacgagtacgaccgacggtcccgacggacgcgtaacgtcggtaacctaagttagtagggaaggtaagtagggaggacgcgtaggaacggtacgttacgggaacccgaacggtaccgggttacccgtttaaagtaacgtttaccgtaggtacggtaaccggaaggtaaaacggtaggaaaacgggtaaacgggtcggtaacctaaacgtaaacggttaaccgg

SEQ ID NO: 332141 - DNA, 537 bp, Homo sapiens
  misc_feature: GZ8MTXP02GEAL5.8.39.D06.1.454.CMB.2.raw
  modified_base (389)..(389): a, c, t, g, unknown or other
  misc_feature (389)..(389): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacgaagggcctggagtggagtggggagaaatcgaacccccgagtggaggtggtgacgagagtacgcccagtagttcgaggcagagtcncatgaccagtcgacacgtccgacgacgcacgtgtactagtatggagtagtagaggagcctagacgacgtgaacgacgacggtaccgtactaattacgtcgtagcgtaagaacgtacgaaacggtaaacgggtgactaacaagtaaccg

SEQ ID NO: 332142 - DNA, 564 bp, Homo sapiens
  misc_feature: GZ8MTXP02FPNO0.8.39.D06.1.454.CMB.2.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (403)..(403): a, c, t, g, unknown or other
  misc_feature (403)..(403): n is a, c, g, or t
  modified_base (447)..(447): a, c, t, g, unknown or other
  misc_feature (447)..(447): n is a, c, g, or t
tcagctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccnccctgtctttgtctccgtgggggganagccaccctctcctgcagggccagtntaaccttttagagttagttatttagcctggtatcggacaaaacctggccaggcctccccgactcctctttcttggtggagctttacgagggccactggccaccccagaccnggatcacgtggcaggcgggtcnggggacngacttcattctcacatcaaanagactgacacgcctagagtatattgactagtttactactgtcanctagtatgtaccgtccgtggtacgttccggacgtaaggggacctaaaggtcgacgtaaataccgaaaccgtacgtaggtcgacgtaacgaccgacctacgttcacgttctcttaacc

SEQ ID NO: 332143 - DNA, 657 bp, Homo sapiens
  misc_feature: GZ8MTXP02FKTHW.8.39.D06.1.454.CMB.2.raw
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
tcagctcgcgtgtccacgaccggtgctcgatttagtgacatctcgcagttctttggggagcatcatccaacaaacacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtgggcctnagtgaagtatttccgtgacaaggcgtccggatacgaggttcaccgccgtntatattaattggctgcgacacggcccctggacgaagggcctggagtggagtggggagaatcgaaccccggagtggaggtggtgcgaaggacgtaccgacccgaaggtacgggtttcgaaggggacaaggacgttacctacccgtaagtacggaacccgaagttacgaacccgaaccggtccccgaccggaacgacctaacgtcgttacctaagtagtaggggagaagtagggaaggtacgacgttaggacgtacgttacggaaaccgacggaccggtaccgtttaaacgttaacgtttaacgtaggttacggaccggtaaaaggaaacgttaaccggaaaaggtaaacgggtacggtaacttaacccgaaagtaacccgg

SEQ ID NO: 332144 - DNA, 508 bp, Homo sapiens
  misc_feature: GZ8MTXP02FKU59.8.39.D06.1.454.CMB.2.raw
  modified_base (328)..(328): a, c, t, g, unknown or other
  misc_feature (328)..(328): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcgagtgaagtatttcctgacgaaggcgtccggatacaggttcaccgccgtctatattaatggctgcgacaggcccctggacaagggcctgagtggatgggganatcaaccccgagtggaggtggtgcagcgtacgcccaggtacgttcagggcagagtctccgatcgaccagtcgacacgtccgcgancacgtgtctatagnggagatagaggagctgagactgacgtacacggctactattactgtgcgagaacgtcgaaagaggtacgctaacacgtaacg

SEQ ID NO: 332145 - DNA, 644 bp, Homo sapiens
  misc_feature: GZ8MTXP02I4F5O.8.39.D06.1.454.CMB.2.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
  modified_base (439)..(439): a, c, t, g, unknown or other
  misc_feature (439)..(439): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatgaagagtccgtgggcctnagtgagtattcngcaaggcgtcgatcaggtcaccgctntatattatggctgcgacncggccccgtaggacagggcctggaggtgggagtaggggaataaagtaccgaaaccccggtagggtgggtaacgggtgggtacgacgtaaggacggttaccgacccgtagggtacggttacgacggggcaagggcttccgtaccaagtcgtaaccgngtacgaccgacggtccgacgagctacgttgtactaatagtacggagtagtaggaacggagtaccgtaaggacgttaacgttacggaaccgaaccgtaccgggtaccgttaaagttacgtttaaacggtccggtaagacggtaaaaggaaaaccggtacggaaaaggggtaacggtacggtacctttaaaacggaactaaccgggg

SEQ ID NO: 332146 - DNA, 557 bp, Homo sapiens
  misc_feature: GZ8MTXP02HG4O9.8.39.D06.1.454.CMB.2.raw
  modified_base (182)..(182): a, c, t, g, unknown or other
  misc_feature (182)..(182): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (387)..(387): a, c, t, g, unknown or other
  misc_feature (387)..(387): n is a, c, g, or t
  modified_base (431)..(431): a, c, t, g, unknown or other
  misc_feature (431)..(431): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtncagctggtgcagtcgtggggctgagatgaagtacgtccgtggggcctcgaggtgaagtatttccgtgacaggcgtccggatacgaggttccaccgccgtctatacttatggctgcgacncggccctggacaggctggagtggagtggganagtcgaaccccgagcggaggtgtgacgagcgacgccaggtacgttcgagggcagngtctaccgagtcgaccagtcgaccgacgtccgcgacgctacgtntactatacgtggagagaggtggacgcgtagagtacgtgaccgtaacgaccggtacgtacttacgtacgtgtacggacgtaagtaaacgtaggaaacgggaggtacggaactaacgaacgtaaccgg

SEQ ID NO: 332147 - DNA, 596 bp, Homo sapiens
  misc_feature: GZ8MTXP02G3JLR.8.39.D06.1.454.CMB.2.raw
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttccngcaaggcgtccggatacaggttcaccgccgtctatattaatggntgcgacaggcccctggacaagggcctagagtggagtggggagaagtcgaacccccgaggtcggaggtggtgacgaggacgtaccgcccgaggtacggttcgaggggtcagacgtctccgatgaccagtagacgacgtccgcgacgcaacgtgtactagtagtaggagagtaggaggacgtccgtaggacgtacgttacgaaccggacgtaaccggggtcccttaaacgttagttacgtaggttacggacggtaaacgtaaagtacggaaaacgggtaaagggtacggtaaccttaacgaaacgttaacccgg

SEQ ID NO: 332148 - DNA, 582 bp, Homo sapiens
  misc_feature: GZ8MTXP02JBL95.8.39.D06.1.454.CMB.2.raw
  modified_base (229)..(229): a, c, t, g, unknown or other
  misc_feature (229)..(229): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtcgtggggctgagatagaagagtccgtggggcctnagtgaagtactttcctgcgaaggcgtacggatacgaggttcaccgtccgtactatattatggactgcgtacacggccccgtaggacaagggcctaggacggtaggagtaggggaataaacgtccgaacccccggagtgggaagggttcgggtagacgagacggtaccgacccgaggtacgttcgagggacagacgtctcgatcgaccagtanaccgacgtccgngagctagtcgtctatagtggagagtaggagacgcctaggacgtacgtacgacgaacgtacggtcttaagtacttacgtggtacgacggaagaacgtacggaaggtaaggtcgtactaacgaacgttccg

SEQ ID NO: 332149 - DNA, 754 bp, Homo sapiens
  misc_feature: GZ8MTXP02FH0P6.8.39.D06.1.454.CMB.2.raw
tcagctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcaggtcgtggggctgagatgaagacgtccgtggggcctcgagtagaagtactttcctgagaagggtccgtacggactacgacgttccgacccgtccgtcttaatatttagtggcgtgacgaccgaccggcccgtaggaaccgacgggcctggaggtgggtaggtaggggaaagtaacgtaccgaacccccgggtaggtaggggtaggtcgggtagacggaaggtacggtacccggaccggtaaggggttaacgggtttacgacggggactagggtaccgttccgtacccgtagtaccggtaccgtacggtaccggaccgtacccggtacccggccggtaaccggaccgttaacgttcccgttagttaagtacggtagggaagtaggtagggaacgggtaaccgtccggtaggtaacgttaccggttaccggaaaccggacccggtaaccgggttaccgttaaacgtttaaacgtttaccggtagggttacggaacgtaaccggtaaaggtaaaccgggtaaaacggaaggggttaccggtaaacttaccgaacggtaaccggg

SEQ ID NO: 332150 - DNA, 582 bp, Homo sapiens
  misc_feature: GZ8MTXP01A05UF.15.33.C11.1.454.CMB.2.raw
  modified_base (349)..(349): a, c, t, g, unknown or other
  misc_feature (349)..(349): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (497)..(497): a, c, t, g, unknown or other
  misc_feature (497)..(497): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacagaatattaacctgttccatcgactacgcttcggcctcgcttagggcactcaccctgccccgattacgtgacaggaccttggtcttcggngagcgggctttcgaccgtctttatcgttacttactgtcagcattcgcaacttctgactacctccagcactnctcacacncacaccttacacacgacttacacaacacctacccctaacccaaccaaaccacaactaacgacgtcgccncgccgcgcgcgtcgtcgctacgttcgttaccgtcccgttccgttcttccttccctcctaactctcgttacgtcgttaacgtaacg

SEQ ID NO: 332151 - DNA, 605 bp, Homo sapiens
  misc_feature: GZ8MTXP01DOI84.15.33.C11.1.454.CMB.2.raw
  modified_base (407)..(407): a, c, t, g, unknown or other
  misc_feature (407)..(407): n is a, c, g, or t
  modified_base (437)..(437): a, c, t, g, unknown or other
  misc_feature (437)..(437): n is a, c, g, or t
  modified_base (463)..(463): a, c, t, g, unknown or other
  misc_feature (463)..(463): n is a, c, g, or t
  modified_base (512)..(512): a, c, t, g, unknown or other
  misc_feature (512)..(512): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttctccgtcccccttcgcagtaacaccaagtacagaatattaacctgttcccatcgactacgcctttcggcctcgccttagggcgactcaccctgccccgattaacgtgacaggacccttggtcttccggcgagcgggtctttcgaccgtctttactcgttacttatgtcagcattcgcncttctgactaccctcagcatcgctcacacncactacctcacacgcttacacgaccnccctaccccgaacccaaacgaacacaactaacgcgtcgcctcgcccgcncgtcgttcgtcgttcgtacgttacggtttaccgttcccgttccgttccttcccttcccgtacctaactctcgttacgtaacgttaacgtaacg

SEQ ID NO: 332152 - DNA, 589 bp, Homo sapiens
  misc_feature: GZ8MTXP01AZ5VS.15.33.C11.1.454.CMB.2.raw
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
  modified_base (466)..(466): a, c, t, g, unknown or other
  misc_feature (466)..(466): n is a, c, g, or t
  modified_base (500)..(500): a, c, t, g, unknown or other
  misc_feature (500)..(500): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacagaatattaacctgtttcccatcgactacgcctttcggcctcgccttaggggtcactcaccctgccccattaacgtggacaggaacccttggtcttcggcgagcgggcttttcacccgntttatcgttacttangtcagcattcgcncttctgactacctccagcatcgcctcacagccacaccttcacgaggcttacaggaacccncctaccccaaccaacgaccacaatacgcgtcgcncgccgcgcgtcgtcgtcgttctacgttcgttaccgttcccgttccgttcttcccttccctcctaactctcgttacgtcgttaacgtaag

SEQ ID NO: 332153 - DNA, 607 bp, Homo sapiens
  misc_feature: GZ8MTXP01BYTHW.15.33.C11.1.454.CMB.2.raw
  modified_base (455)..(455): a, c, t, g, unknown or other
  misc_feature (455)..(455): n is a, c, g, or t
  modified_base (523)..(523): a, c, t, g, unknown or other
  misc_feature (523)..(523): n is a, c, g, or t
  modified_base (537)..(537): a, c, t, g, unknown or other
  misc_feature (537)..(537): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttctccgtcccccttcgcagtaacaccaagtacagaatattaacctgttcccatcgactacgcctttcggcctcgccttaggggtcactcaccctgccccgattaacgttggacaggaacccttggcttccggcgaggcgggtcttttcacccgtctttatcgttacttactgtcagcattcgctcttctgactacctccagcatcgcctcacagccacaccttcacncggcttacacgaacgccctaccccgtaaacccaaacaaccgacaataacggccgtacgcctcgcccgnacgtcttcgggtcnctacgttggtttaccgtccccgttttcacgttcccttccccgctaattcgaggactccgttaacgtaacg

SEQ ID NO: 332154 - DNA, 635 bp, Homo sapiens
  misc_feature: GZ8MTXP01B8FES.15.33.C11.1.454.CMB.2.raw
  modified_base (394)..(394): a, c, t, g, unknown or other
  misc_feature (394)..(394): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatattaacctgttcccatcgactacgcctttcggcctcgccttagggcactcaccctgccccgattacgtggacaggacccttggtcttccggcgagcgggtctttcgaccgtctttatcgttacttangtcagcattccgctcttctgactaccctcagcatgcctcacagcacacccttcacaggccttacacgaaccgccctacccctaacccaaacaaccgacactaacgccgtacggcctcggcccgccgacgtccttcgggtcgttccgtaacgttcgggttttaacccgccccgtttttaccacgtttcccctttcccccggcctaacttccgtacggacggtaacccttaacggttaaccgg

SEQ ID NO: 332155 - DNA, 609 bp, Homo sapiens
  misc_feature: GZ8MTXP01DFEW0.15.33.C11.1.454.CMB.2.raw
  modified_base (273)..(273): a, c, t, g, unknown or other
  misc_feature (273)..(273): n is a, c, g, or t
  modified_base (526)..(526): a, c, t, g, unknown or other
  misc_feature (526)..(526): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacagaatattaaccngtttcccatcgactacgcctttcggcctcgccttaggggtcactcaccctgccccgataacgtgacaggaacccttggtcttcggcgagcgggctttcacccgtctttatcgttacttatgtcagcatttcgctaacttctgactaccctcagcatcgcctcacagccaacaccttcacagcttacagaacgcctacccctaacccaaacaaccgcaattaacgcgtacgctcgccgcacgctttcgggtacnctaacgttcggtttaacgcccccgttttcgacttccctttccccggaccctaacgtccttacgacggtccttaaccggtaagg

SEQ ID NO: 332156 - DNA, 552 bp, Homo sapiens
  misc_feature: GZ8MTXP02G8WOP.15.33.C11.1.454.CMB.2.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (503)..(503): a, c, t, g, unknown or other
  misc_feature (503)..(503): n is a, c, g, or t
  modified_base (523)..(523): a, c, t, g, unknown or other
  misc_feature (523)..(523): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgtgacaggacctgctcgcagcgggctttcacccgntttancgttactatgtcagcattcgcncttctgactacctccagcatgcctcacagcacaccttcacagcttacagaaacgcctacccctacccaaacaacgcaataaagccgtcgctcgccgcagcttcggncattggttacgccccgtttnacttctcccgcactctgacgctacgtacg

SEQ ID NO: 332157 - DNA, 605 bp, Homo sapiens
  misc_feature: GZ8MTXP02J26KI.15.33.C11.1.454.CMB.2.raw
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (470)..(470): a, c, t, g, unknown or other
  misc_feature (470)..(470): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggacccttggtcttccggcgagcgggcttttcacccgctttatcgttacttatgtcagcattcgcncttctgatacctccagcatcgcctnacngccacnccttcacaggccttacacgaaacccnccctaccccaaccaacaacgacaactacgcgtcgctcgcccgcacgtcgttcggtcgcgtacgttacggtttaccgtcccgttccttaccttcccgttccccgtcccgtacctcgtacgtacgtacgtacgtacg

SEQ ID NO: 332158 - DNA, 580 bp, Homo sapiens
  misc_feature: GZ8MTXP02H5BGT.15.33.C11.1.454.CMB.2.raw
  modified_base (410)..(410): a, c, t, g, unknown or other
  misc_feature (410)..(410): n is a, c, g, or t
  modified_base (539)..(539): a, c, t, g, unknown or other
  misc_feature (539)..(539): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttgacaggacccttggtcttcggcgagcgggcttttcacccgctttatcgttacttactgtcagcattcgcncttctgactacctccagcatgcctcacacgcaccaccttcacacggcttaacagaaaccgcctaccccctaaccccaacaaccgcaataaacgcgtcgctcgccgcagccttcggtgccatggtttacnccccgtttcacttccttcccgcatctaggacactacgtacg

SEQ ID NO: 332159 - DNA, 591 bp, Homo sapiens
  misc_feature: GZ8MTXP02GHWQX.15.33.C11.1.454.CMB.2.raw
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgtggacaggaacccttggtcttccggcgagcgggctttcacccgtntttatcgttactatgtcagcattcgcncttcngactacctccagcatcgcctcacagcactaccttcacaggcttaacgagaaaccgcctacccctaacccaacaacgcaataacgcgtcgactcgcccgcacgccttcggtcgctacgttcgggtttaccgcccccgtttacacttcccttcccgcctatcctgacgtctaacgtacg

SEQ ID NO: 332160 - DNA, 587 bp, Homo sapiens
  misc_feature: GZ8MTXP02JHTP8.15.33.C11.1.454.CMB.2.raw
  modified_base (509)..(509): a, c, t, g, unknown or other
  misc_feature (509)..(509): n is a, c, g, or t
  modified_base (520)..(520): a, c, t, g, unknown or other
  misc_feature (520)..(520): n is a, c, g, or t
  modified_base (547)..(547): a, c, t, g, unknown or other
  misc_feature (547)..(547): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccgaccaacatagccttctccgtcccccttcgcagtaacaccaagtacaggaatattaacctgtttcccatcgactacgcctttcggcctcgccttaggggtcactcaccctgccccgattaacgttggacaggacccttggcttccggcgagcgggcttttcacccgtctttatcgttacttactgtcagcattcgcacttctgactacctccagtcatcgcctcacagcacaccttcacacgcttacagaaaccgccttaccccaacccaacaacgcaataacgcgtcgctgcccncagcgttcgcnctacgttcggttaccgtccccgttacnccttccgtcccgcctactcgtacgacgtaccgtacgtacg

SEQ ID NO: 332161 - DNA, 575 bp, Homo sapiens
  misc_feature: GZ8MTXP02GQFH0.15.33.C11.1.454.CMB.2.raw
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
  modified_base (506)..(506): a, c, t, g, unknown or other
  misc_feature (506)..(506): n is a, c, g, or t
  modified_base (537)..(537): a, c, t, g, unknown or other
  misc_feature (537)..(537): n is a, c, g, or t
  modified_base (558)..(558): a, c, t, g, unknown or other
  misc_feature (558)..(558): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacagaatattaacctgttcccatcgactacgccttcggcctcgccttagggcactcaccctgccccgatacgtgacagacccttgtctcggcgagcgggtctttcacccgtctttatcgttacttatgtcagcacttcgctcttcngactaccctccagcatcncctcacagcacaccttcacagtctacagaaccncctaccccaccaacaacgcataacgcgtcgctcgccgcagtccttcgggcncgtacgttcggtttaccgtcccccgtttacncttcccttcccgctactccgngtaacgcgttacgtacg

SEQ ID NO: 332162 - DNA, 644 bp, Homo sapiens
  misc_feature: GZ8MTXP02F7ZA9.15.33.C11.1.454.CMB.2.raw
  modified_base (370)..(370): a, c, t, g, unknown or other
  misc_feature (370)..(370): n is a, c, g, or t
tcagtctacgtagccacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgacttaaaccgggacaaccgtcgcccggccaacatagccttcctccgtccccccttcgcagtaacaccaagtacaggaatattaacctgttccatcgactacgccttcgcctcgccttaggggcgactcacctgccccgattacgtgacagacctggtctcggcgagcgggtcttcaccgtntttatcgttactatgtcagctattcgctcttcagtactacctccagtcatcgcctcacagccaactacctcactacggactaacgacgaaaccgtccctacccctaacccaaacaaccgacaataaacgcgtacgcctcgcccgactacgtcctttcggtcgacttacggtttacggttttaacccgggttcccccgttttacaacctttccccgttaaccccggtaccctttaacttcccgttagaaccggtacctttaacccggttaaacgg

SEQ ID NO: 332163 - DNA, 595 bp, Homo sapiens
  misc_feature: GZ8MTXP01CJ8YU.4.66.F11.1.454.CMB.2.raw
  modified_base (385)..(385): a, c, t, g, unknown or other
  misc_feature (385)..(385): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtgggggaggcttgataaagccgtgggggtcccttagactctcctgtgcagcctctggattcaccttcagtgacgactggatgaattggatccgcaggctccgagggagggctggagtggggtcgccatattaacgacccaaaatgaacgtaggggaaacagacctacgctgcacccgtagacgnggcagattcaccattcaaagagatagaattacaaaaagtacaactagtatcgtaggaaatagaactagcctagagaatacgacgacacacgtaccgttatacgtgacgaagaaggagggactacgttacgtcggtcccgttacgggggcccgaacggggtaaccccgtggggtccctaacccggtcccttacctccgaaccggtcccccg

SEQ ID NO: 332164 - DNA, 606 bp, Homo sapiens
  misc_feature: GZ8MTXP01CDDN0.4.66.F11.1.454.CMB.2.raw
  modified_base (388)..(388): a, c, t, g, unknown or other
  misc_feature (388)..(388): n is a, c, g, or t
  modified_base (515)..(515): a, c, t, g, unknown or other
  misc_feature (515)..(515): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtgggggaggcttgataaagccgtgggggtcccttagactctcctgtgcagcctctggattcaccttcagtgacgactggatgaatggatccgcaggctccgagggaagggctggagtgggtcgccatattaacgacccaaaagtgaaacggtaggggaaacagaacctacgctgccacccgtagagnggcagacttcacctattcaaagagtaatagtaattaacaaaaagtactaaacttaggtaatacgtaggaaaattagaaacgacgaccgtaggaagaactacgaacgaacacaagtaccgtttatacngtacgaggaagagggctacgttacgtcggtcccgttacggggccgaacgggtaaccctcgggtccaccccgtcttccctcgcgtaaccccg

SEQ ID NO: 332165 - DNA, 615 bp, Homo sapiens
  misc_feature: GZ8MTXP01CVRG9.4.66.F11.1.454.CMB.2.raw
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (377)..(377): a, c, t, g, unknown or other
  misc_feature (377)..(377): n is a, c, g, or t
tcagagcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaggtgtccagtgtgaggtgaaactggtggagtcgtggggagcttgataaagccgtgggggtccctagactctcctgtgcagcctntgattcaccttcagtgacgactggangaattggatccgcaggctcgagggagggctggagtgggtcggcatattaacgacccaaagtgaacgtagggaaacagacctacgctgcacccgtagagnggcagagttacaccgattacaagagtatagaatacaaaagtacactagtatacgtaggaaatagaaccgtagaccgtagaagaactaccggaacgacaacgtagtacccgtttaagttaccagaccgaaggaaacggaggacgtaacttaggtaccggggtccgaccgggggttcccgaaccggggtaacccgtcgggtccgtaccccgtcggttacccttccgaaccgtaacccccg

SEQ ID NO: 332166 - DNA, 679 bp, Homo sapiens
  misc_feature: GZ8MTXP01A6JSG.4.66.F11.1.454.CMB.2.raw
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
tcagagcactgtagcacgaccggtgctcgatttagtcacgcgagaagggggggagaggagccccagccttgggattcccaagtgttttcattcagtgatcaggactgaacacagaggactcaccatggagtttgggctgagctggtattttccttactgctaattttaaaggtgtccagtgtgaggtgaaactggtggagtcgtgggggagcttgataagccgtgggggtcccttagactctcctgtgcagcctctggtattccacccttcagtgacgactggatgaattggactccgcaggctccgaggggagggctggaggtgggtcgactatattaacgacccaaaagtgaaacggtggggaaacnggaccctacgctgaccacccgtagagnggaccagacttaccacctatttacaaagagatagaattaacgtaaaaagtactaacgttgtaatacgtaaggaaaagtagaaaaccgtaggtaccctaagggaaacgtaaacgtacccggaaacgaaccaacgtacgttacccgttttataacgtacgacgaaaggaaaggacgggactaacgttaggttaccgggtcccggttacgggggaccccaaccgggggtaaccccgttcggggtaacccctaacggttccccttcccgtaaccgccggtaaccccc

SEQ ID NO: 332167 - DNA, 664 bp, Homo sapiens
  misc_feature: GZ8MTXP01ERSR5.4.66.F11.1.454.CMB.2.raw
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
tcagagcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtgggggaggcttgataaagccgtggggggtcccttagactctcctgtgcagcctctggattcaccttcagtgacgactggatgaatggatccgcaggctccgagggagggctggagtgggtcgccatataacgacccaaaactggaaacgtgggggaaacncgaacctacgctgccacccgtgagngcagatcactattcaagagatgaattacaaaaagtctaactagtatacgtagaaatgaaacgagaccgtagaagtaaactccgaacgacaacgtacgttaccgttttataccgtagaccgaaaggaaacggaacggggttacctaaacgttacggttaccgggggtacccccggttaggggggaccccgttaaccggggggtaaaccccttcggggttaacccctaaccccgggtttccttaccccgttaacccgttaacccgggtaacccccccg

SEQ ID NO: 332168 - DNA, 602 bp, Homo sapiens
  misc_feature: GZ8MTXP01DR9AV.4.66.F11.1.454.CMB.2.raw
  modified_base (428)..(428): a, c, t, g, unknown or other
  misc_feature (428)..(428): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgaactggattttccttactgctattttaaaaggtgtccagtgtgaggtgaaactggtggagtcgtgggggaggcttgaataaagccgtggggggtcccttagactctcctgtgcagcctctggattcaccttcagtgacgactggatgaattggatccgcaggctccgagggagggctggagtgggtcgcatattaagcccaaaagtgaagtgggaaacagactacgctgcaccgtgaagagcagatcacattcaagatatagaattaacaaaagtacaacttagtaactntaggaaatagaaacagcctagggaacgtaataccgacgaacactacgtaccgttttaaatacctagacgaaggaaggaagggacttacgtacgttcggtcccggtggggacccgttcgggaaaccccgtgggtaccaacccggttctacccgttccgtaaccgcccgtaacccg

SEQ ID NO: 332169 - DNA, 662 bp, Homo sapiens
  misc_feature: GZ8MTXP01BQSYW.4.66.F11.1.454.CMB.2.raw
  modified_base (171)..(171): a, c, t, g, unknown or other
  misc_feature (171)..(171): n is a, c, g, or t
  modified_base (351)..(351): a, c, t, g, unknown or other
  misc_feature (351)..(351): n is a, c, g, or t
tcagagcactgtagcacgaccggtgctcgatttagtcacgcgagaagggggggagaggagccccagccttgggattcccaagtgttttcattcagtgatcaggactgaacacagaggactcaccatggagtttgggctgaactggattttccttactgctattttaaaggngtccagtgtgaggtgaaactggtggagtcgtgggggaggcttgataaagccgtgggggtcccttagactctcctgtgcagcctctggattcaccttcagtgacgactggatgaattggatccgcaggctccgagggaggctggagtggcgcatataagacccaaatgaacgtgggaaacngactacgctcgcaccgtgaagacgcagattacacctattacgaaagacgatacgaattaacaaaagtaccatagtatactaggaaatacgaaacaggtcctaggggaagtaaagtaccgaaacgtaacacctaacggttacccgttttaaatacgttaacggacctaaaggaaacgggaacgggaacttaacgttaacgggttccgggtacccggttacgggggacccggttaaacgggggttaaccccgttcgggtcccgaacccggtttccctaccccgttacgtaaccccgttccccgtaacccccgg

SEQ ID NO: 332170 - DNA, 586 bp, Homo sapiens
  misc_feature: GZ8MTXP01BFOK8.4.66.F11.1.454.CMB.2.raw
  modified_base (277)..(277): a, c, t, g, unknown or other
  misc_feature (277)..(277): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
tcagagcactgtagcacgaccggtgctcgatttagtcacgcgagaagggggagaggagccccagccttgggattcccaagtgtttcattcagtgatcaggactgaacacagaggactcaccatggagtttgggctgagctggattttccttactgctatttaaaggtgtccagtgtgaggtgaaactggtggagtcgtggggaggcttgataaagccgtgggggtcccttagactctcctgtgcagcctctggattcaccttcagtgacgactggangaattggatccgccaggctccgagggaggggctggagtgggtcgccatataagcccaaaatggaacgtaggggaaacagacctacgctgcacccgtagagnggcagattcgacctattcaagagatgaattacaaaagtacaactntatctaggaaatgaacagcctagagaactcgaacgacacagtccgtttaatacgtgcaagggaaagaggggacaccgttagtcgggtcccgttcggggggcccttaacggggaaccccttgggttaacccgacccgtccgttccctaaccgaacgtaaccccg

SEQ ID NO: 332171 - DNA, 627 bp, Homo sapiens
  misc_feature: GZ8MTXP01BDIQD.4.66.F11.1.454.CMB.2.raw
  modified_base (253)..(253): a, c, t, g, unknown or other
  misc_feature (253)..(253): n is a, c, g, or t
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
  modified_base (591)..(591): a, c, t, g, unknown or other
  misc_feature (591)..(591): n is a, c, g, or t
tcagagcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctggggagcttgataaagccgtgggggtcccttagactctcctgtgcagcctntggattcaccttcagtgacgactggatgaattggactccgccaggcctccgagggagggctggagtgggtcgcatataacgacccaaactgaacgtaggggaaacagaccctagctcgcacccgtagacgnggcaagatcacctattaacaaganataggaattaacgaaaagtacaacgttagtatacttaggaaatagaaacacgaccgtagaagtaacgtacgaacgaccagacgtaccgtttaacttacgacgacgaagaacggtaaggttcgaacgttaggtccgggtcccggttacgggggaccccgaggggtaacccccgtgggtaacccnccccggttacttccccgttaacgcccgtaacccccg

SEQ ID NO: 332172 - DNA, 571 bp, Homo sapiens
  misc_feature: GZ8MTXP02IRE47.4.66.F11.1.454.CMB.2.raw
  modified_base (380)..(380): a, c, t, g, unknown or other
  misc_feature (380)..(380): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctatttaaaaggtgtccagtgtgaggtgaaactggtggagtctgggggaggcttgataaagcctgggggtcccttagactctcctgtgcagctctggattcaccttcagtgacgactggatgaattggatccgccaggctccgagggaagggctgggagtgggtcggccatattaagcccaaaatgaaacgtggggaaacagacctacgctgcacccgtgagnggcagattcaccatttcaaagagatgattacaaaaagtacaactgtatactaggaaatgaaacagcctagagaatcgacgacacgagtccgtttaattacctagacagaaacggagggcactagtcggtcccgtacgggggcccgacggggaacccgtcggtaccgtacccggtctccctcgacgtccccg

SEQ ID NO: 332173 - DNA, 565 bp, Homo sapiens
  misc_feature: GZ8MTXP02G8GJ4.4.66.F11.1.454.CMB.2.raw
  modified_base (379)..(379): a, c, t, g, unknown or other
  misc_feature (379)..(379): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctggggaggcttgataaagcctgggggtcccttagactctcctgtgcagcctctggattcaccttcagtgacgactggatgaattggatccgccaggctccgagggagggctggagtgggtcggccatattaagcccaaaatgaaacgtggggaaacagacctacgctgcacccgtgagnggcagattcaccatttcaaagagatgattacaaaaagtcaactgtaatcgtaggaaatagaaacaggcctagagaatcgaacgacacgagtccgttaatactagacagaagacgggcaacgtagtcggtcccgtgggggacccaaggggaacccctgggtcccaccggtctacccgtcacgtcccc

SEQ ID NO: 332174 - DNA, 555 bp, Homo sapiens
  misc_feature: GZ8MTXP02J2VCY.4.66.F11.1.454.CMB.2.raw
  modified_base (251)..(251): a, c, t, g, unknown or other
  misc_feature (251)..(251): n is a, c, g, or t
  modified_base (381)..(381): a, c, t, g, unknown or other
  misc_feature (381)..(381): n is a, c, g, or t
tcagagcactgtagcacgaccggtgctcgatttagtcacgcgagaagggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctggggaggcttgataaagcctgggggtcccttagactctcctgtgcagcctntggattcaccttcagtgacgactggatgaattggatccgccaggctccgagggaaggggctggagtgggtcggccatattaagcccaaaactgaaacgtggggaaacagacctacgctgcacccgtgagnggcagattcacatttcagagatgattacaaaagtacactgtatctaggaaatgaacagacctagagaatacgacgacacgagccgtttactactagacagaacgagggacacgtatcggtcccgcggggacccacggggaacccgtggccgaccggtcctcccgtcacgccccg

SEQ ID NO: 332175 - DNA, 773 bp, Homo sapiens
  misc_feature: GZ8MTXP02HAPJJ.4.66.F11.1.454.CMB.2.raw
  modified_base (258)..(258): a, c, t, g, unknown or other
  misc_feature (258)..(258): n is a, c, g, or t
  modified_base (588)..(588): a, c, t, g, unknown or other
  misc_feature (588)..(588): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtggggaggcttgataaagcctgggggtcccttagactctcctgtgcagcctctggtnttcaccttcagtgacgacgtggatagtaagttggactcccgccgacggcctacccggaggggaacggggccgtgggaggttcggggtccggaccctaagttaacgtttaaaccgaaccccctaaaaacgtacggtaaaaccggggttacggggaaaaaccaacggaaacccccgttacggacccgttacggacccgtaacccccgggtggaaacggacggggaccaaggtaaactttcccgaaaccctatttaaccgaaagaagtataggtaaacttaaacgaaaaaagtaccctaaagttagtaattacgtaagggtaaaatgaaaacncgaaccgttagaaacggtaacaccgggaacgaaccaacgacgttacccgttttaaattaccgtacgagaaaggaaacggagggtaccctaagtacgtaccggggttacccgacgggggacccgaaaccggggtaaccccgtggggtaccctacccggtccttacccgtacgaacccgtacccccg

SEQ ID NO: 332176 - DNA, 594 bp, Homo sapiens
  misc_feature: GZ8MTXP02GA2VK.4.66.F11.1.454.CMB.2.raw
  modified_base (381)..(381): a, c, t, g, unknown or other
  misc_feature (381)..(381): n is a, c, g, or t
  modified_base (452)..(452): a, c, t, g, unknown or other
  misc_feature (452)..(452): n is a, c, g, or t
tcagagcactgtagcacgaccggtgctcgatttagtcacgcgagaagggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctgggggtcccttagactctcctgtgcagcctctggattcaccttcagtgacgactggatgaattggatccgccaggctccgagggaagggctggagtgggtcggccatattaagcccaaaactgaaacgtggggaaacagacctacgctgcacccgtgagnggcagattcaccatttcaagagatgattacaaaaagtacaactgtatactaggaaatgaaacagcctaganaagtacgaacgaacaacagtacccgtttaagttactacgacaaggaagagggacgtacgtaactcgggtaccccgtacgggggcccaaacggggtaacccgtcgggtacctaacccggtcctccgtacccgacgtacccccg

SEQ ID NO: 332177 - DNA, 579 bp, Homo sapiens
  misc_feature: GZ8MTXP02HT409.4.66.F11.1.454.CMB.2.raw
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
tcagagcactgtagcacgaccggtgctcgatttagtcacgcgagaagggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtgggggaggcttgataaagcctgggggtcccttagactctcctgtgcagcctctggattcaccttcagtgacgactggatgaattggatccgccaggctccgagggaagggctggagtgggtcggcatattaagacccaaaatgaacgtggggaaacngacctacgctgaccaccgtgagnggcagattccacatttacaagagatgaattaacaaaagtacactagtatacaggaaatagaaacagtcctagaagaactacggaacgaacaacgtacgtaccgtttaattaccgtgacaaggaggacgggacaacgtagtcggtacccgtcgggcccgaagggtaacccgtcggtacctaccgtctcctcacgtaccc

SEQ ID NO: 332178 - DNA, 599 bp, Homo sapiens
  misc_feature: GZ8MTXP02GJ3M8.4.66.F11.1.454.CMB.2.raw
  modified_base (382)..(382): a, c, t, g, unknown or other
  misc_feature (382)..(382): n is a, c, g, or t
  modified_base (463)..(463): a, c, t, g, unknown or other
  misc_feature (463)..(463): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtgggggaggcttgataaagccgtgggggtcccttagactctcctgtgcagcctctggattcaccttcagtgacgactggatagaattggatccgccaggctccgagggagggctggagtgggtcgcatataacgacccaaaagtgaaacgtagggaaacagactacgctgccaccgtgagnggcagattcacctatttcaaagagatagaattaacaaaaagtacaactagtaatactaggaaaatgaaacagacctagaanaatacgaacgaacacacgtaccgtttaatactagacaagaaaggacggactacgtagtacggttacccgacggggacccgaacggggaaccccgtggtacccgtaacccggtccttaccctaccgtacgtaccccc

SEQ ID NO: 332179 - DNA, 782 bp, Homo sapiens
  misc_feature: GZ8MTXP02IKSVC.4.66.F11.1.454.CMB.2.raw
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggtattttccttactgtcttaattttaaaaggtgtccagtgtgaggtgaaactggtggagtcgtggggagcttgataagccgtgggggtccttagactctctgtgcagcctntgtacttccaccttcagtgaccgtntggatagagttgactcccgcgacggcgtacggaggggacgggcgtggaggtcggggtaccgactaagtaattaaacggaccctaaaagtacggaaacggtaggggaaacacgtaaccccgtacgcctacggaccgtaccggtagaacggacggactaacgtacttaccgtaaaccttagtttaacgaaaggagttaagtaacggtaaacttaaaacgaaaacgttaccgtaaagttacggttaataacggtaaggaaacctaagaaaccgtaaccgtacgtaacggtaaacgtacgttaaccggaaacccgtataaacccggttaacggtttaaccgttttaaacgtaaccgaggtaaaaccgaaaacggtaggaaccggggtaaccttaaaccgtacgggttacccgggtacccgggtaccggggtaaccgtaaacccggggttaacccgtccggtaacccgtaccctaaccggtttccccaacggtaccccgtaaccccgg

SEQ ID NO: 332180 - DNA, 600 bp, Homo sapiens
  misc_feature: GZ8MTXP02I1W3P.4.66.F11.1.454.CMB.2.raw
  modified_base (382)..(382): a, c, t, g, unknown or other
  misc_feature (382)..(382): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtgggggaggcttgataaagcctgggggtcccttagactctcctgtgcagcctctggattcaccttcagtgacgactggatgaattggatccgccaggctccgagggaagggcgtggagtgggtcggcatataacgccaaaatgaaacgtaggggaaacagacctacgctgccaccgtgagnggcaagacttcacctatttacaagagatagataacaaaagtacactagtaatacgtaaggaaatagaaacgacgaccgtagagaaactacgggacaacacgtacgtaccgtttaacttacgtagacaagaagagggacctagtacgtaccggtacccgtacggggacccgaacgggaacccgtcggtaccacccggtcctcccgtacgacgtaccccg

SEQ ID NO: 332181 - DNA, 556 bp, Homo sapiens
  misc_feature: GZ8MTXP02HZPZL.4.66.F11.1.454.CMB.2.raw
  modified_base (383)..(383): a, c, t, g, unknown or other
  misc_feature (383)..(383): n is a, c, g, or t
  modified_base (476)..(476): a, c, t, g, unknown or other
  misc_feature (476)..(476): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggagcttgataaagcctgggggtccctagactctctgtgcagcctctggattcaccttcagtgacgactggatgaattggatccgcagctccgagggagggctggagtgggtcgccataattaacgaccctaaaacgtgaaaccggtaggggaaacagacctacgctgccaccgtgagngtcagacttcacctagttacaaagatatagtaattaacgaaaaagtcaactagtatacgtaaggaatagaaacagcctagaagaatcgacganacagtaccgttatactgacaagacgagacactagtcgccgtgggaccacgggaacctcgacgacgtcctacgtcacgccc

SEQ ID NO: 332182 - DNA, 589 bp, Homo sapiens
  misc_feature: GZ8MTXP02GG9HP.4.66.F11.1.454.CMB.2.raw
  modified_base (377)..(377): a, c, t, g, unknown or other
  misc_feature (377)..(377): n is a, c, g, or t
tcagagcactgtagcacgaccggtgctcgatttagtcacgcgagaagggtgggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtgggggagcttgataaagccgtgggggtcccttagactctcctgtgcagcctctggattccaccttcagtgacgactggatgaattggatccgcaggctcgagggagggctggagtggtcgcatataacgaccaaaagtgaacggtggggaaacacgactacgctgcacccgtgngaggcagatcactattcaagagatagaatacaaaagtacactagtatactaggaaatagaaacagacctagaacgtaagtaccgaacgtacaacgagttacccgtttaattaccgtgacgaaggaaggaggactacgtacgttccgggtacccgtacgggggaccaacggggtaacccgtaggtaccctaccggtcctacccgtaccgaccg

SEQ ID NO: 332183 - DNA, 635 bp, Homo sapiens
  misc_feature: GZ8MTXP02JK3LU.4.66.F11.1.454.CMB.2.raw
  modified_base (376)..(376): a, c, t, g, unknown or other
  misc_feature (376)..(376): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtcgtggggagcttgataaagccgtgggggtcccttagactctcctgtgcagcctctggattccaccttcagtgacgactggatgaattggatccgccaggctccgagggagggctggagtgggcgcatataagcccaaaatgaacgtggggaaacagacctacgctgcacccgtgagnggcaggattccacctatttacaagagatagattacaaaagtacatgtatcgtaggaaatgaaacagacctaggaagaagtaccgaacgaacacgaacgttacccgtttaattacgtagacgtaacggaaaggacggggacctaaacggttaacggttcgggttacccccgtacggggggaccccgtaacgggggtaaacccccgtcggggttaacccgaccccggttcccgttaccccgtccggtaaccgtaccccccg

SEQ ID NO: 332184 - DNA, 654 bp, Homo sapiens
  misc_feature: GZ8MTXP02HQN6A.4.66.F11.1.454.CMB.2.raw
  modified_base (383)..(383): a, c, t, g, unknown or other
  misc_feature (383)..(383): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctggggaggcttgataaagccgtgggggtcccttagactctcctgtgcagcctctggattcaccttcagtgacgctggatgaattggactccgcaggctccgagggagggcgtggaggtgggcggccatagtaacgacccaaaagtgaaacggtgggaaacagacctacgctgccaccgtgagngcagacttcactattacaaagatatagattaacaaaaagtactaactagtactacgtaaggaaatacgaaacacgtacctaaggtaaagaacgtaccggaacgaaccgaaccgtacgttaccgtttaaacgttaccgtagtaccgaaaggtaaacggacggggtacctaaaccgtaacggttccggggtaccccggtacgggggtaccccgaacgggggtaaccccgtcggtaccgtaccccgttacgtcccctacgtaacccgtcccccg

SEQ ID NO: 332185 - DNA, 608 bp, Homo sapiens
  misc_feature: GZ8MTXP02JZRF5.4.66.F11.1.454.CMB.2.raw
  modified_base (388)..(388): a, c, t, g, unknown or other
  misc_feature (388)..(388): n is a, c, g, or t
  modified_base (415)..(415): a, c, t, g, unknown or other
  misc_feature (415)..(415): n is a, c, g, or t
  modified_base (455)..(455): a, c, t, g, unknown or other
  misc_feature (455)..(455): n is a, c, g, or t
  modified_base (474)..(474): a, c, t, g, unknown or other
  misc_feature (474)..(474): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctggggagcttgataaagcctgggggtcccttagactctcctgtgcagcctctggattcaccttcagtgacgactggatgaattggatccgccaggctaccgaggggaagggctgggagtgggtcgccatattaagacccaaaatgaaacgtaggggaaacagacctacgctacgacacccggtgacgnggcagacttacacctatttccaaaganatgaatacaaaaagtacaactgtatcgtagaaatgaaacngacctagagaatgaccganacgagtccgtttatacgtgacaaggtaaagacgggctaacgtacgtacggttaccccggacggggtaccgaacggggtaacccccgttcggttaccgaccccggtccctttacccgtaccgtaacgtccccccg

SEQ ID NO: 332186 - DNA, 621 bp, Homo sapiens
  misc_feature: GZ8MTXP02F9T82.4.66.F11.1.454.CMB.2.raw
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttccttactgctattttaaaaggtgtccagtgtgaggtgaaactgggtggagtcgtgggggaggcttgataagccgtgggggtcccttagactctcctgtgcagcctctggattccaccttcagtgacgactggatgaattggactcccgccaggcctaccgaggggaagggcgtgggaggtggggtccggacctataacgttaaacgaccccaaaagtgaaagtggtaggggaaacacggaacctacgctacgaccacccggtagacggagcagtacttccaactatttacaaagagatagaattaacaaaaagtacactagtaatactagaaatagaacagactagaagaactacgaacgacacgtacgtaccgtttatacgtgacgtaagaaggacgggactacgtacgtacggtacccggtacgggaccgaacgggtacccgtacggtaccaccgtcctccgacctaccg

SEQ ID NO: 332187 - DNA, 579 bp, Homo sapiens
  misc_feature: GZ8MTXP02F6M13.4.66.F11.1.454.CMB.2.raw
  modified_base (361)..(361): a, c, t, g, unknown or other
  misc_feature (361)..(361): n is a, c, g, or t
  modified_base (381)..(381): a, c, t, g, unknown or other
  misc_feature (381)..(381): n is a, c, g, or t
  modified_base (423)..(423): a, c, t, g, unknown or other
  misc_feature (423)..(423): n is a, c, g, or t
  modified_base (509)..(509): a, c, t, g, unknown or other
  misc_feature (509)..(509): n is a, c, g, or t
  modified_base (572)..(572): a, c, t, g, unknown or other
  misc_feature (572)..(572): n is a, c, g, or t
tcagagcactgtagcacgaccggtgctcgatttagtcacgcgagaaggggggagaggagccccagccttgggattcccaagtgttttcattcagtgatcaggactgaacacagaggactcaccatggagtttgggctgagctggattttcctactgctattttaaaaggtgtccagtgtgaggtgaaactggtggagtcgtgggggagcttgataaagcctggggggtcccttagactctcctgtgcagcctctggattcaccttcagtgacgactggatgaatggatccgcagctccgagggagggcgtggagtggggtcgccatattaacgacccaaaacgtgaacggtggggaaaacngaccacgctgcaccgtgagngcagattcacatttacaagagatagtattaacgaaaagtaanactagttaatcgtaggaaatgaaacacgacctagaagaatacccggaagaacccagtagtcccgtttaattacgtagacagaacgngtaccagtacgtcggttaccgcggggaccacgggaacccgtggtaccgtaccgtcctcctacncgtaccc

SEQ ID NO: 332188 - DNA, 541 bp, Homo sapiens
  misc_feature: GZ8MTXP01CNQGH.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggccccctcatctatggtgcatccaaacagggccacgtggcatccccagccaggttcagtcggcagtgggtatggggaacagcttcactctcacatcatcagcctggagcctgaggtatgtgctagtttatactgtacaactatcgtaccgagtcggcccgtcgggggacctacgtttcggcccgtcggaacctaaaggtggatacacgaaacgtaacttgttcggctgacaactatcttacgtcttcgtaac

SEQ ID NO: 332189 - DNA, 534 bp, Homo sapiens
  misc_feature: GZ8MTXP01DWOV4.8.34.D01.1.454.CMB.2.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtatcctggtaccaacagaaacctggccaggctcccaggcccctnatctatggtgcatccaaacngggccactggcatcccagccaggttcagtggcaggtgggtatgggaacagcttcactctcaccatcatcagcctggacgcctgaggattgtgctagtttattactgttacaaactatacgtaccgagtcggcccgtccgggggcctacgtttccggccctgggaccaaaggtggatacgacgaaacgattcgttggctgacaacatcttgtcttctaac

SEQ ID NO: 332190 - DNA, 530 bp, Homo sapiens
  misc_feature: GZ8MTXP01CMYNZ.8.34.D01.1.454.CMB.2.raw
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (525)..(525): a, c, t, g, unknown or other
  misc_feature (525)..(525): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggggcctagtatcctggtaccaanagaaacctggccaggctcccaggcccctnatctatggtncatccaangggccactggcatccccagccaggttcagtgccaggtgggtatgggacagacttcactctcaccatcatcagcctggagcctgaggatgttgctagtttattactgtacaacgtatcgtaccgagtcggccgtccgggggccacgtttcggcccgtcgggaccaaagtggattatacaaacgaactgttggcttgcaccaatctgttcttcncttcc

SEQ ID NO: 332191 - DNA, 585 bp, Homo sapiens
  misc_feature: GZ8MTXP01A219F.8.34.D01.1.454.CMB.2.raw
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagttttcagataccaccggagagattgtgttgacacaatctccagccaccctgtcttcgtctccaggggaaanagccaccctctcctgcagggccagtcagaatgttggcncctagtatcctggtaccaacagaaacctggccaggctcccaggcccctnatctatggtncatccaangggccacgtggcatcccagccaggttcagtcgcaggtggtangggaacagtcttcactcncacntcatcagtctggacnctgacgtattgtgcttagtttatactgtacaacgtagttccgtaacggtagttcggcccgttccgggggcctacgtttccggacccgttgggaaccctaaaggttcggataacgttaccgaaaacggtacgttggttcggttaccgttaaggccctaaccgtacgttcgttacggttccgtttaactaaccg

SEQ ID NO: 332192 - DNA, 822 bp, Homo sapiens
  misc_feature: GZ8MTXP01A7WUI.8.34.D01.1.454.CMB.2.raw
  modified_base (207)..(207): a, c, t, g, unknown or other
  misc_feature (207)..(207): n is a, c, g, or t
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagctcgcgtgtccacgaccggtgctcgatttagatcgtctgtgttgggtttggggaggaactgctcagttaggacccagagggagccatggaagccccagctcagcttctcttcctcctgctactctggctcccagtttcagataccacggagagattgtgttgacacaatctccagccaccctgtcttcgtctccaggggaaanagccaccctctcctgcagggccagtcagaatgttggcgcctacgtatcctggtaccaanagaaacctggccaggctcccaggcccctanatctatggtnacactaccgaaacgacgggcctacgtcggaccactaccccgacgaccgtagggttaccaacggtcgggacgtaaggggttagggggtaagtaacgggggaaacctaacggtaacctttacctaaaccttcctacccaaacctaacttacctaacgttacgaacggtcccgttacgggaacgtacccgttagggtaacgggtagttacggttacggtacgtttaaaggtttttaactttaaccgtttacggggttaaacctaaaaccgtaaccgttaacccgggtaaacccggtaacggggttcccggggtaccccgggttaccccggggggtaccccttaacccgggttttacccggggtacccccgggttaacgggggtaaaacccgtaaaacggggttacgggtaaacgttaaacgtaaaaccgtaaaaaccggttaaacggttcgggttacgggtaaccgttaccggaacccgtaacccgtaaccgttaccgtttccgtttcccgtttaaccg

SEQ ID NO: 332193 - DNA, 535 bp, Homo sapiens
  misc_feature: GZ8MTXP01DIKER.8.34.D01.1.454.CMB.2.raw
  modified_base (515)..(515): a, c, t, g, unknown or other
  misc_feature (515)..(515): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccagcccctcatctatggtgcatccaacagggccactggcatccccagccaggttcagtcggcaggtgggtatgggaacagcttcactctacaccatcatcagcctggagcctgaggatgttgcagtttattactgttacaactagtcgtaccgagttcggccgtccgggggccaccgtttcggccctggggaccaaaggtcggatattacgaaacgacttgttgctgcncctatcttcgtcttcgtaac

SEQ ID NO: 332194 - DNA, 559 bp, Homo sapiens
  misc_feature: GZ8MTXP01AI6Y8.8.34.D01.1.454.CMB.2.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagcccaccctctcctgcagggccagtcagaatgtgcgcctacgtacctggtaccaacagaaacctggccaggctccccacggcccctcatctatggtgcatccaacagggccactggcatcccagccaggttcagtggccaggtggggtatcggacaaagcttcactctcaccatcatcagcctggagcctgagatcgttgctagtttactactagttcaactagtcgttaccgaggtcggcccgtccgggggcctaccgtttcggcccgtagggacctaaggtcggattacgtacgaaacgaacgtggttcggcttcgaacacctaatcgtacgttcttcaacttcccg

SEQ ID NO: 332195 - DNA, 550 bp, Homo sapiens
  misc_feature: GZ8MTXP01AG8DL.8.34.D01.1.454.CMB.2.raw
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatcccaaacgnggggcccacgtggcactccccagccaggttcaggtcggcaggtgggtanggggaacagccttcactctcaccatcatcagcctggacgctgaggatgtgctagtttatactgtacaactagtcgtaccgaggtcggccgtccgggggcctacgtttccggcccgtgggacctaaggtggactacttacgaaacgtacgttggttcggctgcaacgatcttagtcttctaac

SEQ ID NO: 332196 - DNA, 744 bp, Homo sapiens
  misc_feature: GZ8MTXP01ESAC3.8.34.D01.1.454.CMB.2.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctccccaggccccctanatctatggtgcactacccaacgacgggacccacgtcggaccctaactcccccgaggcccgtaagggttccaggtcggacgtagggtggggtaagtcggggaaacacgtcctttcactcctacaccatcatacacgtccgtggacgtccgtaggtaaggtagttggttacgtacgttaagtttaactttaacgttacgttaaccgtaaaccgttaacgtttacccggttaaccgggtacgggttccgggtccccgggttaccccggggggtacccgttacccggttttcccggggtaccccggttaccgggggtaaacccgtaaaacgggttacgggttaaacgttaaacgttaaaccgtaaaaccggtaacgttacgggttcgggttaccgtaacggtaccctaacccgtacgttaccgttacgtttcccgtttaaccgtaaccg

SEQ ID NO: 332197 - DNA, 544 bp, Homo sapiens
  misc_feature: GZ8MTXP01DZI7I.8.34.D01.1.454.CMB.2.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (492)..(492): a, c, t, g, unknown or other
  misc_feature (492)..(492): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggaggtcacagagactctcgtgtgcagcctctgggttcaccttcagtaactacggcatgcactgggtcccncaagctccaggcaagggnttgggagtgggtgctagttgtttcatctgagggcagtgttcaagtggtatgcagactcgtgaagggcgattcacatctacagagacaattccaaggaacacaagtgttatttggagctgaacagacctaagtcctagaggacaacgggcgttatacttagtagtacggaaagggngggggaaccgaaggacgggaacgttcgaaggttacttccgtttggtaaccgg

SEQ ID NO: 332198 - DNA, 569 bp, Homo sapiens
  misc_feature: GZ8MTXP01B7OJN.8.34.D01.1.454.CMB.2.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (407)..(407): a, c, t, g, unknown or other
  misc_feature (407)..(407): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagcctgggaggtcacagagactctcgtgtgcagcctcgtgggttcacctcagtaactacggcatgcacgtgggcccnccaagctccgaggcaagggnttgggagtggggtgctagttgttcatcgtgagggcagtgttacaagtggtatgcagactcggtagacgggcgatcacatctacaganacaattcaagaacacaagtgtagtttgagtctagaacagacctaagtcccgtaggacggaacgtaacggggtattaagtacgttacgtacggtaacggaaaggggacgggggaaccgaagggcgggtaacgttaccgaacgttacgttccgttggtaaccgg

SEQ ID NO: 332199 - DNA, 578 bp, Homo sapiens
  misc_feature: GZ8MTXP01BRL5K.8.34.D01.1.454.CMB.2.raw
  modified_base (322)..(322): a, c, t, g, unknown or other
  misc_feature (322)..(322): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctcgtgtgcagcctcgtgggtccacctcaagtaactacggcatgcacgtggtcccacaagctccgaggacaagggtnttgggagtgggtgctagttgttcatcgtggaggctagtgttcaagtggtatgcagacgtcgtagacggcattcactatctaccagacgaactaactaccaaggaaacaacaagttagttaagtttggagtctagaacgacgtacctaacgtccgtaggacggacgaacgggtacttagtacgttacgtaggtaacggaaggggcgggggaaccaagggccgggtaacgtacccgaagttactccgtttggaaccgg

SEQ ID NO: 332200 - DNA, 552 bp, Homo sapiens
  misc_feature: GZ8MTXP01CMZG7.8.34.D01.1.454.CMB.2.raw
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
  modified_base (452)..(452): a, c, t, g, unknown or other
  misc_feature (452)..(452): n is a, c, g, or t
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggttcaccttcagtaactacggcatgcactgggtccnccaagcctccgaggcaaggggntttgggagtgggtgcagttgtttccatcgtggagggcaagttgttcaaatgggtatgcaggactccggtgaagggccgattcaccatctccagacgacaattccagaacacgaatgtattgganctgaacagcctaagtcctgaggaacacgggctanacgtacgtggttacggaagggacgggggaaccnggcgggagttccgaagtaaccgttccgttaagg

SEQ ID NO: 332201 - DNA, 554 bp, Homo sapiens
  misc_feature: GZ8MTXP01EOZRE.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgttggcgcctagtatcctggtaccaacagaaacctggccaggctcccgaggcccctcatcctatggtgcatccaaacgcggggcccacgtggccactccccagccaggttcagtcggcaggtgggtatggggaacagtaacttcactcctcaccatcatcagcctggagcctggaggtatgttgctagtttattactgtacaatacgtcgtaccgaggtcggcccggtccgggggtcctacgtttccggccgtgggaaccaaagtggatacttacgaaacgtacttgttggctgcaaccatcttgtcttctcg

SEQ ID NO: 332202 - DNA, 617 bp, Homo sapiens
  misc_feature: GZ8MTXP01DQ36G.8.34.D01.1.454.CMB.2.raw
  modified_base (274)..(274): a, c, t, g, unknown or other
  misc_feature (274)..(274): n is a, c, g, or t
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctcgtgtgcagcctcgtgggttcaccttnaagtaactacggcatgcacgtgggtcccnccaagctccgaggcaagggnttgggagtggggtgctagttgttcatctggaggcagttgttcaagtggtatgcagactcggtagacgggcgattcacatctaccagacgacaattaccaaggaaacactaagttagttagtttggagtcgtagaacacgtaccgttaaacgtcccgtaggacgggaaccgaacggggtacgttaagtaaccgttaacgtacgggtaacgggaaagggggcggggggaaaacccgaaggggtaccggggtaacgtttaccggaacgttaccgttccggtttaacggtaacccggg

SEQ ID NO: 332203 - DNA, 509 bp, Homo sapiens
  misc_feature: GZ8MTXP01DFQ7D.8.34.D01.1.454.CMB.2.raw
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgcccaccctctcctgcagggccagtcagatgtgcgctagtatcctgaccanagaactgcagctcccagccctnatctatggtncataccgaaacgacgggccacgtggcactccccagcctaggttcaggtcggctaggtgggtatggggaaacagtccttcacttcacaccatcatcagcctggacnctagaggtntgtnattagttatactnacactgtcgacgngtcgccgtcggactcgtcgcgtggacaagtgatanacgaacgtcngcgcngacaactntcttntcttcgtc

SEQ ID NO: 332204 - DNA, 556 bp, Homo sapiens
  misc_feature: GZ8MTXP01BAMT3.8.34.D01.1.454.CMB.2.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccnccaagctccaggcaaaggggatttggagtgggtgcagtgttcatntgaggcaagtgttnaatggtatgcagactccgtgaaggccggattcaccatactccagagacaataccagaacaacaaatagtatttagagacgagaacagactaacgtactcgaggaacgacggacgtacttaacgtaacgtagttaacggaagggaacgggggaacggaggaacgggacggtacgttaacgtaacgttcgttcg

SEQ ID NO: 332205 - DNA, 679 bp, Homo sapiens
  misc_feature: GZ8MTXP01EPA18.8.34.D01.1.454.CMB.2.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtatcctggtaccaacagaaacctggccaggctcccaggccccctanatctagtggnacactaccgaacgacgggccacgtcggacctacgtcccgagcccgtaggttcgaggtcggacgtagggtgggtagtcgggaaacacgtcttcactctacaacctatacactacacgtccgtagggacgtccgtaggtaggtagttggttacgacgttaagttttaacttacgttcgtaacctaaacgtacgttaccggtaccggtacggttccgggtccccggtaccgggggtacccttaccggtttcccgggacccggtacgggaaaccgtaaagggttacggttaaacttaacgttaaaccgtaaacggtaacgttggttcgttacgtaacgacctaacgtacgttcgttacgttccgttaacgtaacg

SEQ ID NO: 332206 - DNA, 634 bp, Homo sapiens
  misc_feature: GZ8MTXP01BWORC.8.34.D01.1.454.CMB.2.raw
  modified_base (299)..(299): a, c, t, g, unknown or other
  misc_feature (299)..(299): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggaggtcacagagactctcgtgtgcagcctctgggttcacctcagtaactacggcatgcacgtgggtccnccaagctccgaggcaaggggtattgggagtggggtggctaggtttgtttcattcgtggagggctaggttgttacaagtgggtaatgacaaggtacctccgggtaggaacgggccgattccacctatctacccagaacgaacaattacccgaaggaaacaactaaagttagttaagtttaggagtactagaacagtacccgttaagtcccgtaggacggaaccgaacgggtacgttaacgtaacgttacgtacggtaacgggaaacgggggaacggggggaaccgaagggacggggtaacgttaccgaacgttaccgttccgtttcggtaaccggg

SEQ ID NO: 332207 - DNA, 519 bp, Homo sapiens
  misc_feature: GZ8MTXP01AWTVO.8.34.D01.1.454.CMB.2.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
  modified_base (501)..(501): a, c, t, g, unknown or other
  misc_feature (501)..(501): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagatgtgcnctagtatcctgacaanagaacctggccaggctcccagcccctcatctatggtgcatccaacgngggccacgtggcatcccagccaggttcagtcgcaggtgggatgggaacngcttcactctcaccatcatcagcctgancctgaggatgtgctagtttattactgtacaactagtcgtaccgagtcggcccgtccgggggcctacgttccgggccctgggaccaaagtggatattcgaaacgacttggttcgctgcnccatccttgtcttctaac

SEQ ID NO: 332208 - DNA, 590 bp, Homo sapiens
  misc_feature: GZ8MTXP01ASG16.8.34.D01.1.454.CMB.2.raw
  modified_base (211)..(211): a, c, t, g, unknown or other
  misc_feature (211)..(211): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaangcccaccctctcctgcagggccagtcagatgtgcgctagtatcctgtacaacagaacctgcaggctcccacgcccctnatctagtggtncatccaaacgcgggccacgtggcactcccagccaggttcagtcggcaggtgggtatgggaaacagtctcactctccacatcatcagcctggacgccgtgagggtattgtgacgttagtttatacgtgtacaaactgtaccgtaaccgtaggtccggcccgttccgggggtaccctacgtttcccgggcccgttacgggaaccgtaaaggttggaagttaacgaccgtaaaacgtaacgttggcggttcttaacggcctaacccgtattccgttcgttcctttcgtaaccc

SEQ ID NO: 332209 - DNA, 538 bp, Homo sapiens
  misc_feature: GZ8MTXP01D45JZ.8.34.D01.1.454.CMB.2.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (424)..(424): a, c, t, g, unknown or other
  misc_feature (424)..(424): n is a, c, g, or t
tcagctcgcgtgtccacgaccggtgctcgatttagatcgtctgtgttgggtctgggagaggagcccagcactagaagtcggcggtgtttccgttcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctntggttcaccttcagtaactacggcatgcactgggtcccncaagctccaggcaaggggattggagtgggtggctagtttgtttcatctgagggcagtgttcaatggtatgcagactcgtgaagggccatcacatctcagagacattccagaacacaatgtattgggganctagaacagcctaagtcctagaggacgacgggcgtataactacttaggtacggaagggagggggaaccaggcgggatttccaaggtaactccgttgacgtcgttggggtaaccg

SEQ ID NO: 332210 - DNA, 536 bp, Homo sapiens
  misc_feature: GZ8MTXP01A0PGZ.8.34.D01.1.454.CMB.2.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggaggtcacagagactctcgtgtgcagcctctgggtcacctcagtaactacggcatgcactgggccnccaagctccaggcaagggnttggaggtggggngcagttgttcatctgagggcagtgttcaatggtatgcagactccggtagagggccgattcaccatctccagagacaattccaggaacacaatgtattggagctagaacagacctaagtcctagacggacaacgggcgttaatacttacgtagtaacggaaggggacgggggaccaaggcgggaagttcgagttactccgtttgaaccgg

SEQ ID NO: 332211 - DNA, 539 bp, Homo sapiens
  misc_feature: GZ8MTXP01D0MM0.8.34.D01.1.454.CMB.2.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (431)..(431): a, c, t, g, unknown or other
  misc_feature (431)..(431): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagcctctgggttcaccttcagtaactacggcatgcacgtgggtcccnccaagctccgaggcaagggnttggagtgggtggctagttgttcatccgtggagggcagtgttacaattggatgcagactcggtgaacgggcgattcacatctcagagacatccagaacacaatggtattgganctagaacagacctaagtcctagaggacacgggaactattactacgttagtaacggaaggggacggggaccagggcgggtagtccgaagtcttacgttcgaacgtcggg

SEQ ID NO: 332212 - DNA, 556 bp, Homo sapiens
  misc_feature: GZ8MTXP01D5XHF.8.34.D01.1.454.CMB.2.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctgggaggtcacagagactctcgtgtgcagcctctggtcacctcagtaactcggcatgcactgggtcccncaagctccaggacaagggtnttgggaggtgggtgctagttgttcatcgtggaggcagtgtanaagtggtatgcagactcggtagacggcgtatcacatctacagagacaataccaagaacacaagtagttatttaggagtctagaacagacctaagtcctagacggacgaacgggcttagtacttacgtaggtaacggaaggggacgggggaacgaagggacgggtaacgttaccgaaggttactaaccgttggtaaccgg

SEQ ID NO: 332213 - DNA, 741 bp, Homo sapiens
  misc_feature: GZ8MTXP01DWC6N.8.34.D01.1.454.CMB.2.raw
  modified_base (182)..(182): a, c, t, g, unknown or other
  misc_feature (182)..(182): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaacgtggtggagtcgtgggggaggcgtggtccagccgtggggaggtcacagagactcgtcgtgtcgcagtccctcgtgggttccaccttcaagtaacctacggcatgccacgtcgggtcccnccaagcctaccgaggacgaagggtnttgggaggtggggtgtctaggtttgtttcagttcgtaggagggtctaggttgttacaaggttgggtatcggactacggtacgttcgggtagggacgggtccgtaattccaaccgtacttccgtaccgaagtaacgaacctaacgttacccgaaaggtaaacaaccgtaaggtttacgtttaagtttacgggaacgtacgtaacgtaaacgtaacggtaacccgttaaacggtcccgtagggaaccgggtaaccggtaaccgggtacgttaaacgttaaccgttacggtaaacgggtaacggggaaacgggggttacgggggaaaccgtcggggtaacgggtaaccggtttacccgaaacggtttccgttaaccggtttaacgggtaacccggg

SEQ ID NO: 332214 - DNA, 553 bp, Homo sapiens
  misc_feature: GZ8MTXP01EAWK7.8.34.D01.1.454.CMB.2.raw
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctnatctatggtgcatccaacagggccacgtggcatcccagccaggttcagtcggcagtgggtatggggaacagcttnactcncaccatcatcagcctggancctgacggatgtgctagtttattactgtactaaactagttacgtaccgaggtcggcccgtccgggggcctacgtttccggccctgggaaccgaaagtcggaatacttacgaaaacgtaacttggttggcctggcaacctatcttgttccttctaacc

SEQ ID NO: 332215 - DNA, 600 bp, Homo sapiens
  misc_feature: GZ8MTXP01DQWR7.8.34.D01.1.454.CMB.2.raw
  modified_base (269)..(269): a, c, t, g, unknown or other
  misc_feature (269)..(269): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagagccaccctctcctgcagggccagtcagaatgttggcgcctacgtatcctggtaccaanagaaacctggccaggcctcccgaggccccctnatctatggtncactccaaacgagggccacgtggacactccccagccaggttcaggtcggcaggtgggtatggggaacagcttcactctacacatcatcagcctgganctggaagnttgtgacttagtttattactgtacaacgtacgttccgtaccggtagtcgggtcccggtccgggggtccctaccggtttccggcccgttacggggaaccctaaagggtcggaataacgttacgaaaacgtacgttcggttcggttactcggacctaaccgtactccgttcgttccttcgtaaccg

SEQ ID NO: 332216 - DNA, 595 bp, Homo sapiens
  misc_feature: GZ8MTXP01B5B6H.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggagtcacagagactctcgtgtgcagccctctgggttcaccttcagtaactacggcatgcacgtgggtccgccaagcctccgaggcaagggggattgggaggtggggtgctagtttgttcatcgtggaggggctaggtgttcaaatgggtaatgcaggactccggtggaacgggccgattcaccatctccagagacaattaccaggaacacaatgtagttggagctagaacacgcctaagtcctagacggacgacgggcgtaatacgttacgtacggttaacggaaacggggaaggggggaaccgagggaccggggtaagttaccgtaaggttaccgttccgtttacggtaaccggttcggtcggggg

SEQ ID NO: 332217 - DNA, 576 bp, Homo sapiens
  misc_feature: GZ8MTXP01DHGC2.8.34.D01.1.454.CMB.2.raw
  modified_base (269)..(269): a, c, t, g, unknown or other
  misc_feature (269)..(269): n is a, c, g, or t
  modified_base (523)..(523): a, c, t, g, unknown or other
  misc_feature (523)..(523): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctctgggttcacctnagtaactacggcatgcacgtgggtcccgccaagcctcccgaggcaaggggatttgggagtggggtggctaggttgtttcatcgtggagggtcagtgttcaagtgggtatgcagactcgtgaggctatcacatctaccagagacaattaccaaggaaacacaagtcgttagtttggagtactagaacacgtaccctaagtccctaggacggacgtaacggggtcgttatacgttacgtaggtaacggaacggggngggggaaccaagggacgggtcgttaccgacggttacttccgttcggtaaccgg

SEQ ID NO: 332218 - DNA, 801 bp, Homo sapiens
  misc_feature: GZ8MTXP01BA3H2.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtggggaggtcacagagactctcgtgtgcagcctctgggttcaccttcagtaactacggcatgcacgtgggtccgccaagcctccgaggcgaaggggtattgggaggtgggggtggctaggtttgtttccagttcgtggaggggtctaagggttcgttcgaaagttgggtaatcggaccgtaacgggtaccgttcccgggtagggaaacgggggtcccgtaagtttcccaacccgtaattcccgttacccgaaaggaacggtaaacctaaaacgtttacccgaaacgggtaaaccaaaccggtaaagtttacgggtttaaacgttttaggggaaacgtaccgttaacggtaaaccgtaaccggtacccgttaaacggttaccccgttagggaaacggggtaaccgtaaggttacgggggtaccgtttaaacgtaaaccgtttaacggttacgggggttaaaccggggaaaggggggtaaaccggggggggtaaacccgaacgggggtacccgggggtaacggtttaccccgggtaaaacgggtttaacccggttttaaccccgggg

SEQ ID NO: 332219 - DNA, 573 bp, Homo sapiens
  misc_feature: GZ8MTXP01EDQRV.8.34.D01.1.454.CMB.2.raw
  modified_base (298)..(298): a, c, t, g, unknown or other
  misc_feature (298)..(298): n is a, c, g, or t
  modified_base (529)..(529): a, c, t, g, unknown or other
  misc_feature (529)..(529): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctcgtgtgcagcctcgtgggttcacctcagtaactcggcatgcacgtgggccnccaagcctccgaggcaaggggtattgggagtggggtgctaggtttgttcatcgtggagggctaggttgttacaagtggtatgcagacgtcggtagaacgggcctatcacatctaccagagacattccaaggaacactaagtgttagttggagctagaacagacctaagtcctaggacggacgaacgggtcttagtacgttacgtggtaaacggaaggggacgggggaacgngggacgggtaacgttaccgacgttacgttccgtttggtaaccgg

SEQ ID NO: 332220 - DNA, 765 bp, Homo sapiens
  misc_feature: GZ8MTXP01A9WUY.8.34.D01.1.454.CMB.2.raw
  modified_base (322)..(322): a, c, t, g, unknown or other
  misc_feature (322)..(322): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagcctcgtggttccaccttcagtaactacggcatgcacgtcgggccaccagcctcgaggcgaaagggtnttgggaggttggggtggctaggtttgtttcagttccgtgggaggggtctaggttcgttaacaagtggtatcgactacggtaccgtcggtaggaaacggggtccctaattacccgaacctactacctaccgaaaggaacgtaaacctaaacgttaacccgaacggtaaacccaaacgtaaacgttggggtttaaagttttacgggaacgttaccgttaacggaaaccgtacggtaacccgttaaacggttaccccgtaaggggaaccgggaaaccggtaaccgggggtaactttaaacgttaccggttaaacggttaaacggggttaaacggggaaacggggggttaaaccggggggttaaaccgaacgggggtaaccggggtaaccgttaacccgtaaacgggttacccgtttaccgtttcgggttaacccgggttccggggg

SEQ ID NO: 332221 - DNA, 596 bp, Homo sapiens
  misc_feature: GZ8MTXP01C94B4.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctcgtgtgcagcctcgtgggttccacctcagtaactacggcatgcacgtcgggcccaccaagcctaccgaggcaaaggggtattgggaggtggggtgctagtttgtttcagtcgtgagggctaggtgttacaagtggtatgcagacgtcggagaacggccgtattcacctatcctacgaagagaacaagttaccgaaggaaacaactaaattagttaagtttaggagactagaacagtaccctaaagtccgtaggacggacgaacgggacgttaatacgttacgtggaacggaaggggacgggggaaccaagggacgggtaagttaccgaagttactccgttggtaaccgg

SEQ ID NO: 332222 - DNA, 647 bp, Homo sapiens
  misc_feature: GZ8MTXP01D1NAV.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggaggtcacagagactctcgtgtgcagcctcgtgggttcaccttcaagtaactacggcatgccactgggtcccgccaagcctacccgaaggacgaaagggtattgggagtggggtgctaggtttgtttcagtcgtaggagggtctaggttgttacaagttgggtactcggactacggacgttccggtaggaacgggccgtacttccacctagtcctacaagagaacaacttaccaaggaaacactaaagttagttagtttaggacgtcgtaacgaacgtacgaccgttaaacgtccgtaggaacggaaccggaacgggtacgttagtaacgttacgtagggtaacgggaaaggggacgggggaaaccgaagggtacgggtaacgttaccgaagttaccgttaacgttcggtaaccggg

SEQ ID NO: 332223 - DNA, 594 bp, Homo sapiens
  misc_feature: GZ8MTXP01CYQX9.8.34.D01.1.454.CMB.2.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (489)..(489): a, c, t, g, unknown or other
  misc_feature (489)..(489): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcacgtgggtccncaagctccgaggcaagggnttgggagtggggtgctaggttgtttcatcgtggagggctagtgttcaaaattgggtaatgctggacgccgtaggaacgggccattcaccatctaccagacgacaactaccaaggaacactaatcgttagttcgacctagaacagacctaagtccgtaggacggtacgacgggtntaactaactaacgttaggtaacgggaaggggaacgggggaaccgagggccggggttacgttaacccgaagtccgttcgttggaccgtcggttcgggggtaacccg

SEQ ID NO: 332224 - DNA, 586 bp, Homo sapiens
  misc_feature: GZ8MTXP01C4IH0.8.34.D01.1.454.CMB.2.raw
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
  modified_base (401)..(401): a, c, t, g, unknown or other
  misc_feature (401)..(401): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggaggtcacagagactctcgtgtgcagcctctggtcacctnagtaactacggcatgcacgtcgggtcccnccaagcctacccgaggacgaaaggggntttgggagtggggtgctagtttgttcatcgtggagggcagtgttacaagtgtatgcagactcgtgagcatcacntcacagagacaatccaagaacactaagtgttagttagagtactagaacgagacctaagtccgtagacggaacgtaacgggacttaactaacgttacgttacggtaacgggaaaggggacgggggaaaccgaagggtaccgggtaacgttacccgaagttacccgttcgtttaacggtaacccggg

SEQ ID NO: 332225 - DNA, 588 bp, Homo sapiens
  misc_feature: GZ8MTXP01EBN56.8.34.D01.1.454.CMB.2.raw
  modified_base (270)..(270): a, c, t, g, unknown or other
  misc_feature (270)..(270): n is a, c, g, or t
  modified_base (352)..(352): a, c, t, g, unknown or other
  misc_feature (352)..(352): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggagtcacagagactctcgtgtgcagcctctgggtcaccttnagtaactacggcatgcacgtgggtcccaccaagcctaccgaggacgaaggggattgggagtggggtgctagttgttcatccnggagggcagtgtaacaatggtatgcagactcggtagaacggcgatcacatctacagagacaataccagaacanaatggtatttgganctagaacagactaaacgtcctagacggacgacgggtaacgtaacgttacctaacgttaggtaaacgggaaaggggaacgggggaaccgacgggaacggggtacgttaaccgtaacggttaccttccgttaacggttaacggttccgggg

SEQ ID NO: 332226 - DNA, 619 bp, Homo sapiens
  misc_feature: GZ8MTXP01DG0L0.8.34.D01.1.454.CMB.2.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaggggaaanacgccaccctctcctgcagggccagtcagaatgtggcnctagtatcctgaccaanagaacctggccaggctcccaggcccctnatctatggtgcatccaaacgacgggcccacgtggccaacgtccccagcccgaggttcaggtcggctagggtgggtatggggaacagtaacttcacttcacaccatcatcagccgtggacgcctaggaggtatgttgacttagtttatacttagtacgtaaactacgttaccggtaccggtaggtcgggtcccgttcccgggggtaccctaccggttttcccgggacccgttacggggaacccgtaaaggtggaactacgttaccgaaaacgtacgttaggttcggctaacggacctaactacgtcgttacgttccttcgttaaccg

SEQ ID NO: 332227 - DNA, 674 bp, Homo sapiens
  misc_feature: GZ8MTXP01CTDAS.8.34.D01.1.454.CMB.2.raw
  modified_base (247)..(247): a, c, t, g, unknown or other
  misc_feature (247)..(247): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (379)..(379): a, c, t, g, unknown or other
  misc_feature (379)..(379): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagacgcccaccctctcctgcagggccagtcagatgtgcnctagtatcctgaccacagaacctggccaggctcccacgcccctnatctatggtcncatcccgaaacgacgggcccacgtggaccactccccgaagtcccgtaaggttcaggtcggactagggtggggttaanggggaacagtccttcacttctaccacatcatcgacgccgtggacgtccgtaggaggtattggttcgtacgtttagtttaacttacgttacgtaactaaacgtacggttaccgtacccggtagggtccggtaccccgggttcccgggggtacccttaccgggtttccccgggacccggtacggggaaacccgtaaagggtcggttaaacttaacgttaacgtaaaaaccggtcgttagggttcgggttacctaacggacctaacccgtattccgttcgtttcctttccggtaaccc

SEQ ID NO: 332228 - DNA, 650 bp, Homo sapiens
  misc_feature: GZ8MTXP01CZU9D.8.34.D01.1.454.CMB.2.raw
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgtggcgctacgtatcctggtaccaanagaaacctggccaggctcccaggcccctnatctatggtncataccaacgaggggcccacgtggccactcccccgagcccaaggttcaggtcggctaggtgggtatgggaacagcttcactctacaccatcatcagcctggacgccgtgaggtattgttcgctagtttattacgtcgtacaaactagttaccgtaccggtaggtcggtacccggttccggggggtaccctaccggttttcccgggaccccgttacgggggaacccgtaaaagggttcgggaaacgttaacgttaaccgtaaaaaccggtaaccgttagggttcgggttaccgttcgggaaccctaacccgttaattcccgttacgtttcccgtttccgttaaccg

SEQ ID NO: 332229 - DNA, 618 bp, Homo sapiens
  misc_feature: GZ8MTXP01BQDQB.8.34.D01.1.454.CMB.2.raw
  modified_base (292)..(292): a, c, t, g, unknown or other
  misc_feature (292)..(292): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagacgccaccctctcctgcaggccagtcagatgtgcgctagtatcctgtaccaacagaaacctggccaggctcccacggcccctnatctatggtgcatccaacgacggggcccacgtggccatccccgagcctaggttcaggtcggctaggtggggtatggggaaacaggtcttcactctcacctatcatcagccgtggacgtccgtgaggtattgttcgctagtttatacttcgtacaactacgtacgtaccgtaggtcggcccggttccgggggaccttaccggtttcccgggacccgtacggggaacccgtaaaagggttcggttaaagttaaccgttaacgaaaaccggtaacttcgggttcggcgttaacgacctaacctacgtcttacgttcctttcgtaacccg

SEQ ID NO: 332230 - DNA, 531 bp, Homo sapiens
  misc_feature: GZ8MTXP01AIFXG.8.34.D01.1.454.CMB.2.raw
  modified_base (208)..(208): a, c, t, g, unknown or other
  misc_feature (208)..(208): n is a, c, g, or t
  modified_base (317)..(317): a, c, t, g, unknown or other
  misc_feature (317)..(317): n is a, c, g, or t
  modified_base (503)..(503): a, c, t, g, unknown or other
  misc_feature (503)..(503): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggccccctcatctatggtgcatccaaacngggccactggcatcccagccaggttcagtggcaggtggatggggaacaggcttcactctcaccatcatcagcctggagcctggaggatgttgctagtttatactgtacaacagtcgtaccgagtcggccgtccgggggcctaccgtttcggccctgggaaccaaagtggatattacaaacgtaacngttcggctgcaacatcttgtcttctaac

SEQ ID NO: 332231 - DNA, 559 bp, Homo sapiens
  misc_feature: GZ8MTXP01BQM19.8.34.D01.1.454.CMB.2.raw
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtggtccagcctggggaggtcacagagactctcgtgtgcagcctctgggttcacctcagtaactacggcatgcactgggtcccgccaagcctccaggcaagggatgggagtgggtggctagttgttcatcgtgagggcagtgttcaagtgggtactgcagactcgtagaagggccgattcaccatctaccagagacaattccaaggaacaactaagtgtaagtttggaacgctagaacagacctaacgtcctagacggagaacggcgttagtacttacgtagtaacggaagggacggggaacaaggcgggaagtccgagttactccgttaagtaacgg

SEQ ID NO: 332232 - DNA, 661 bp, Homo sapiens
  misc_feature: GZ8MTXP01EQTDB.8.34.D01.1.454.CMB.2.raw
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaagagccaccctctcctgcagggccagtcagaatgttggcgcctagtatcctggtaccaacagaaacctggccaggcctcccaggcccctnactctatggtgcactccaaacgngggccctacgtggccactccccagccaggttcaggtcggcaggtgggatgggaacagtcttcactctacaccatcatcagccgtaggacgccgtaggacggtattcggttgacttagtttacttacgttacgtactaaactacgttaccggtaccggtaggtccggtcccggttccgggggtaccccttaccggtttcccggggaccccgttacgggggaaacccgtaaacgggtcggttaaacgttaacgttaaaccgtaaaacggtaaaccggttggttcgggttaccgttaacggacccgtaacctaacgttccgttacgtttccgttccgttaacccg

SEQ ID NO: 332233 - DNA, 689 bp, Homo sapiens
  misc_feature: GZ8MTXP01D3YBH.8.34.D01.1.454.CMB.2.raw
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgccacgtgggtcccnccaagcctccaaggcaaggggnttgggaggtggggtgctagttgttcatcgtggaggtcaggtgttcaagtggtaatgacagtactccggtaggaacggggtccgtaattccaacctacttacccgttacccgaaagtaacgaacctaaacgttaccccgaaagggaaacctaaaccgtaaagttaggttaagttttagggaacgtacgtaacgaaacacgtaacccgtaacgtcccgttaggacgggaacgaacgggtacgttaacgtaaccgttaacggtacggtaaacgggaaacgggggaacggggggaaaccccgtaaggggaccggggtaacggtttaacccgtaacggttacccgtttcccggttttaacggtaacccgggg

SEQ ID NO: 332234 - DNA, 551 bp, Homo sapiens
  misc_feature: GZ8MTXP01BLULR.8.34.D01.1.454.CMB.2.raw
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (442)..(442): a, c, t, g, unknown or other
  misc_feature (442)..(442): n is a, c, g, or t
  modified_base (508)..(508): a, c, t, g, unknown or other
  misc_feature (508)..(508): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctntgggttcaccttcagtaactacggcatgcactgggtccnccaagctccaggcaagggattgggagtgggtggctagttgttcatcgtgagggcagtgttcaaattgggtaatgcagactccgtgaagggcattcacatctccagagacaatccagaacacaatgttagtttggagtctaggaacngacctaagtcctgacggacacgggcgtaatacttacgtggttaacggaaggggagggggaacccgngggcgggtaagtaccgaagttactcgttagtcgttcgtcgggg

SEQ ID NO: 332235 - DNA, 540 bp, Homo sapiens
  misc_feature: GZ8MTXP01BV0U2.8.34.D01.1.454.CMB.2.raw
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (396)..(396): a, c, t, g, unknown or other
  misc_feature (396)..(396): n is a, c, g, or t
  modified_base (525)..(525): a, c, t, g, unknown or other
  misc_feature (525)..(525): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctnatctatggtncatccaacngggccacgtggcatcccagccaggttcagtcgcaggtgggatgggaacagtcttcactctacaccatcatcagcctggancctgaggtatgttgacttagttattactgtacaactagtccgtacgtacggtcggcccgtccgggggcctacgttccggccgtgggaccaaaggtcggatattacgaaacgacttggttgcgtgcaacntcttcgttcttcgtc

SEQ ID NO: 332236 - DNA, 577 bp, Homo sapiens
  misc_feature: GZ8MTXP01D31TD.8.34.D01.1.454.CMB.2.raw
  modified_base (328)..(328): a, c, t, g, unknown or other
  misc_feature (328)..(328): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (430)..(430): a, c, t, g, unknown or other
  misc_feature (430)..(430): n is a, c, g, or t
  modified_base (541)..(541): a, c, t, g, unknown or other
  misc_feature (541)..(541): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctgtgtgcagtcctgtggtaccacctgaagtaactcggcagtcgctacgtcgggcccacaagcctaccgaggacgaaagggtnttgggaggtggggtgctagtttgttacagtcgtaggaggtcagttcgtanaagtggtancgacagtccgtcgtaggacgggctatccactatctaccgaganactaataccgaagaaactattaaggtgttagttaggatctaagaacagtacctaagtccgaggacgacgaaggtcttataccttagtagtaaggaaggggacgggaaccgnggacggtcgttacgaagttccttcgttggtaaccgg

SEQ ID NO: 332237 - DNA, 590 bp, Homo sapiens
  misc_feature: GZ8MTXP01D5AP6.8.34.D01.1.454.CMB.2.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaagggggaaanacgccaccctctcctgcagggccagtcagaatgtggcncctagtatctgaccaanagaactggcaggctccagccctnatctatggncatccaagacgggccacgtggcactcccagccaggtcaggtcggcaggtgggtatgggaacagtcttcactctcaccatcatcagcctggacgctaggaggtattgtgcttagtttatacgtgtactaaactagtccggtacgaggtcggacccggttcccgggggacccttacggtttccgggaccccgttggggaaacccgtaaaggtggaacttacgttaacgtaaaacggtaacgttgggttcggacttcggacctaaccgtattccgttcgttccgttcgtaacccg

SEQ ID NO: 332238 - DNA, 696 bp, Homo sapiens
  misc_feature: GZ8MTXP01BYD0B.8.34.D01.1.454.CMB.2.raw
  modified_base (301)..(301): a, c, t, g, unknown or other
  misc_feature (301)..(301): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgtggcgcctacgtatcctggtaccaacagaaacctggccaggcctcccgacggcccctnatctagtggtgcactccaacgacgggccacgtggaccactccccgagccctaggttcaggtcggactaggtggggtatggggaaacaggtaaccttcacttctaccaacctatcactcgacgcccgtagggacgccgtagggaacgggtattggttacgacttaagttttacttacgttcgtactaaacgtacggtttaccggtaacccggtagggtccgggtccccgggttacccgggggtacccttaccggtttcccggggaccccgttaagggggaaaccctaaagggtcgggttaaacttaacgttaaaccgtaaaaccggtacgtttcgggttcgggttacttaaccggaccctaaccgttcgttccgttcgttaacccgtttccgtccg

SEQ ID NO: 332239 - DNA, 669 bp, Homo sapiens
  misc_feature: GZ8MTXP01ATVL5.8.34.D01.1.454.CMB.2.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (410)..(410): a, c, t, g, unknown or other
  misc_feature (410)..(410): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaagacgccaccctctctgcagggccagtcagaatgtggcnctagtntcctgtaccaacagaaacctggccaggcctcccacggcccctnatctatggtncactccaacgngggcccagtggcactcccagcctaggttcaggtcggacaggtgggtatagggaacaggccttcactctacacctatcaatcacgccgtgggacnccgtgaacggtattggttgtacgttagtttaacttacgtcggttaaccaaactacgttaccggtaacccggtaaggtccggggtccccggttacccggggggtcccttaaccggggttttcccgggaccccgttacgggggaacccctaaaagggttcgggaattaaacgttaccggaaaaacggtaaccgttgggttacgggttccgttaacgggaccctaacccgtagttcccgttacgttccgtttcccgtaaccg

SEQ ID NO: 332240 - DNA, 745 bp, Homo sapiens
  misc_feature: GZ8MTXP01AKS39.8.34.D01.1.454.CMB.2.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttgcgcctagtatcctggtaccaacagaaacctggccaggctcccaggccccctanatctagtggtcncactacccgaacgcgggacccacgtggacctacgtccccgagacccgtaaggttccaggtccggacgtagggttaggggtaacgtacggggaaactacggtaacctttaccgaccgttcctaccaacctattaccaactaccgacgtcccgtagggaccgtcccgtaggaacggtagttacggttacgtacgtttaagtttttaacttaccgttacgtaaccgtaaacgtacggttacccgggtaacccgggtagggttccgggtccccgggttacccgggggtacccttacccggtttccccgggaccccggttacggggtaaacccgtaaagggtcgggttaaacttaaccgttaaaccgtaaaaccggtaacgttcgggttcggttaccgtcggaccctaacccgtacgttccgttacgttcccttcgtaaccg

SEQ ID NO: 332241 - DNA, 762 bp, Homo sapiens
  misc_feature: GZ8MTXP01EWBAU.8.34.D01.1.454.CMB.2.raw
  modified_base (309)..(309): a, c, t, g, unknown or other
  misc_feature (309)..(309): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctgggagtcacagagactctcgtgtgcagcctcgtggttcaccttcaagtaactacggcatgcacgtgggtcccncaagcctccgaggcgaaagggggtattggggaggtgggggtggctaggtttcgtttccagttcgtaggaggggtctaaaggttgttcaaagttgggtaatcggacgaacggtaccgttcccgggtaggaacggggtcccgtaacgttaccaaccctactccctacccgaagaacgaacctaaacgttacccgaaacggtaaaccaaaccgtaaagttaggtttaaacgtttagggaacgtaccgttaacggaaaccgtaaacggtacccgttaaacggttacccgtacgggtaacggggtaaaccggtaaccgggggttaccgttaaacgttaaccgttaacggttaacgggttaaaccggggaaacgggggaacggggggaaacccggacggggtaaccgggggtaacggttacccggttaaacggttaaccgtttaacccggtttaacggg

SEQ ID NO: 332242 - DNA, 648 bp, Homo sapiens
  misc_feature: GZ8MTXP01EN7AW.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggagcgtggtccagcctggggagtcacagagactctcgtgtgcagcctctgggttcaccttcagtaactacggaatgcacgtgggtcccgccaagcctccgaggcgaaggggtattgggaggtgggggtggcgtaggtttgtttcattcgtggacggggctaggttgttcaaagttgggtaatggactaagaccgtcccggtagggaaacggggccgtacttccaaccatcctaccagacgaacctaacttaccgaacggaacaacaaattagttagtttaggggagtactagaacacgaccgtaagtaccgtagacggacgacgggtacgtataacgtacgttaggtaacgggaaaggggaacggggggtaaccgagggcgggttacggttaaccgtaagtaaccgttcgttacggacgtcggttcggggtaacccgg

SEQ ID NO: 332243 - DNA, 800 bp, Homo sapiens
  misc_feature: GZ8MTXP01EC6OL.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttggactgaactgggttttcctcgttgcttcttttaagaggtgtccagtgtcaagtgcaacgtggtggagtcgtgggggagcgtggtccagccgtgggagtcacagagactctcgtgtgcagcctgtggtcaccttcagtaactacggcatcgcacgtgggcccacaagcctaccgaggcgaagggtattgggaggtggggtgcgtagtttcgttccatcgtggagggtctaaggttcgttaacgaaagttgggtatggaccgtaggtaccgttacccgggtagggaacggggtcccgtaattacccaacctacgttacctacccgaaaggtaacgtaacctaaacgttacccgaaacgggtaaacccaaacggttaaagtttacggtttaaacgttttacggggaaagtacccgttaaaggaaaccgtaaaccggtaacccgttaaacggttaccccgttaagggaacggggtaaacccggtaaccgggggttacctttaaacgttaaacccggttaaacggttaacggggttaaaaccgggggaaaggggggttaaaccggggggggtaaaacccgacgggggttaaccgggggttaaccggtttaacccggttaaacgggtttaaccccgttttaacccgggttttaaccgggg

SEQ ID NO: 332244 - DNA, 549 bp, Homo sapiens
  misc_feature: GZ8MTXP01D79XC.8.34.D01.1.454.CMB.2.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (365)..(365): a, c, t, g, unknown or other
  misc_feature (365)..(365): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (500)..(500): a, c, t, g, unknown or other
  misc_feature (500)..(500): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgcactgggtccncaagctccaggcaagggnttgggagtggggtgctagtttgttcatctggagggcagtgttcaaatggtntgcagacctcggtgaagggcatcacntcncagagacaatcagacacaatgtagttggatctagaacagaccctaagtcctaggacggacgacgggctaatacttagtggttaacggaaggggacgggggaaccgnggacgggtaataccgaagttacgtcgttggtaaccgttcgtaacggggg

SEQ ID NO: 332245 - DNA, 538 bp, Homo sapiens
  misc_feature: GZ8MTXP01DSHWG.8.34.D01.1.454.CMB.2.raw
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (504)..(504): a, c, t, g, unknown or other
  misc_feature (504)..(504): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctgtggtcacctcaagtaactacggcatgccacgtgggtcccnccaagcctcccgaggcaaggggnttgggaggtggggtgctagttgtttcatcgtggagggctaggtgttacaagtgggtatgcagactcgtagacggcatcacntcacaganacatccaagacanagtgtattgagctagaacagacctaagtcctagacggacgaacggcttatacgacgtaggtaacggaaggggcggggaaccngggacggtaagtaccgagttactcgttgtaaccg

SEQ ID NO: 332246 - DNA, 764 bp, Homo sapiens
  misc_feature: GZ8MTXP01CUZEB.8.34.D01.1.454.CMB.2.raw
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (326)..(326): a, c, t, g, unknown or other
  misc_feature (326)..(326): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagcctntggtcactnagtaactacggcatgcctacgtcggggtccccaccaagcctccgaggcgaaaggggnttggggaggtggggtgctaggtttgtttcagttcgtggagggtctaggttgttacaagttggggtaatcggacgaacggtaccgttaccgggtaggaaacggggtccgtactttacccaacctacttacctacccgaaaggaacgtaacctaaacgttacccgaaagggtaaacctaaacgttaaaggtttcgtttaaaggttttagggaacgtaccgttaaggaaacccgtacggtaacccgttaaacggtccccgtagggaacgggtaaccggtaacgggggtaccttaaacgttaaacccgttacggtttaacggggtaaaccggggaaaaggggggttaaccggggggaaaccgtaacggggtaccgggggttaacgtttaccccggtaaaacggtttacccgtttaacccgggttttaagggtaaccccgggg

SEQ ID NO: 332247 - DNA, 526 bp, Homo sapiens
  misc_feature: GZ8MTXP01CQRZ9.8.34.D01.1.454.CMB.2.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (375)..(375): a, c, t, g, unknown or other
  misc_feature (375)..(375): n is a, c, g, or t
  modified_base (482)..(482): a, c, t, g, unknown or other
  misc_feature (482)..(482): n is a, c, g, or t
tcagctcgcgtgtccacgaccggtgctcgatttagatcgtctgtgttgggtttggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggtcactcagtaactacggcatgcactgggtccnccaagctccaggcaagggnttggagtgggtgcagttgttcatctgagggcagtgtcaatggtatgcagactcgngagggcgatcacatctcagacgacaattcagaacacaatgtattggagctgaacagcctaagtcctagaggacaacgggcgttagtacttacgtagtacggaagggngggggaaccgaaggacgggtaagtccgagttacctcgttgtcgg

SEQ ID NO: 332248 - DNA, 762 bp, Homo sapiens
  misc_feature: GZ8MTXP01ASX1C.8.34.D01.1.454.CMB.2.raw
  modified_base (335)..(335): a, c, t, g, unknown or other
  misc_feature (335)..(335): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcggtgtcgcagtcctcgtgggttcacctcaagtaactacggcagtgcacgtcgggtcccgaccaagcctaccgaggacgaaaggggtnttgggagtggggtgctagttgttcatcgtgagggcagtgttacaagtgggtatcgcagtacgtccggtagaacgggtccgtattaccgaacctacttaccgtacccgaaagtacgtaaacctaaacttaccgaaacgggtaaaccaacgtaaaggttaggtttaagtttagggaacgtaccgtaacggaaaccgtacggtaacccgttaaacggtcccggttaacgggaaaccgggaaccggtaaccgggggtaaaccgtttaaacgttaaacccggttaaacggttaaacggggttaaaccgggggaaaacggggggttaaaccggggggttaaacccggaacgggggtacccgggggttaaaccgggtttaacccggtaaaacggtttaaccccgttcccggttttaacggggtaaccccggggg

SEQ ID NO: 332249 - DNA, 586 bp, Homo sapiens
  misc_feature: GZ8MTXP01BOZ36.8.34.D01.1.454.CMB.2.raw
  modified_base (270)..(270): a, c, t, g, unknown or other
  misc_feature (270)..(270): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggaggtcacagagactctcgtgtgcagcctctgggtcacctnagtaactacggcatgcacgtgggcccgccaagctccgaggcaaggggattgggaggtggggtgctagttgttcatcgtgagggcagttgtcaagtggtatgcagactcgtagacggcgatcacatctaccagacgacaattccagaacacaagtgttagttggagtctacgaacagtaccgtaaagtcccgtaggacggacgaaccggggtcttaagtaacgttacgtagggtaaacgggaaaggggacggggggaaaccgaaggggtaccggggtaacgtttaccgaaggttaccgttccgtttcggtaaccggg

SEQ ID NO: 332250 - DNA, 654 bp, Homo sapiens
  misc_feature: GZ8MTXP01AIZN8.8.34.D01.1.454.CMB.2.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctcgtgtgcagcctcgtgggttcaccttcagtaactcggcatgcacgtgggtcccncaagctccgaggcaagggnttgggagtggggtgctagttgttcatcgtggaggcagttgttacaagtggtatgcagactcgtagacggcatcacatctaccagacgacaacttccgaaggaaccaacgaagttaggttaacgtttagggaacgtacgtacgaaaccacgtaccccgtaaaggttccccgtagggaaccgggtaaccgaacgggggtaccttaacgtaaccgttaaccgtaagggtaaacccgggaaagggggttaacggggggaaaccccgaaggggtaccgggggtaacgtttaaccccggaaaggtttacccgttaacccggttttaacggtaacccgggg

SEQ ID NO: 332251 - DNA, 791 bp, Homo sapiens
  misc_feature: GZ8MTXP01BFR2K.8.34.D01.1.454.CMB.2.raw
  modified_base (210)..(210): a, c, t, g, unknown or other
  misc_feature (210)..(210): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttggatttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagcccaccctctccctgcagggccagtcagatgttggcgctacgtatcctggtaccaacagaaacctggccaggcctcccgacggcccctcatcctagtggtncactcccaaacgacgggggacccacgtgggaccaactcccccaggtccctaagggtttccaaggggttcgggacgtaggggttggggggttaactacggggggaaaccaacgggttaccctttacccgaaacccttcccgttacccaaacccctattaccctaaacttccgaaaccggtcccgttagggggaaccgtccccgttaggggaagggttaacgtttgggtttcggactttaaggtttttaacttacgttacggggttactaaacgtaccgttacccgggttaaaccggacggggttccgggtaccccggggttccccggggggtacccttacccgggttttcccgggaccccggtttagggggaaacccctaaaagggttcgggtaaacttacgtaaaccgtaaacggttaaaccgttcgggttacgggccttacggcctaacctacttccgttcgtttccctttaacccg

SEQ ID NO: 332252 - DNA, 575 bp, Homo sapiens
  misc_feature: GZ8MTXP01A95G3.8.34.D01.1.454.CMB.2.raw
  modified_base (317)..(317): a, c, t, g, unknown or other
  misc_feature (317)..(317): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggagcgtggtccagcctggggagtcacagagactctcgtgtgcagcctctgggttcacctcagtaactcggcatgcacgtgggtccaccaagctccgaggcgaaggggnttgggaggtgggggtggctaggtttgtttcagtcgtggagggcaggttgttcaagtggtatgcagactcgtagaggcgatcacatctcagagacatccagaacacaagtgtattggagtctagaacagacctaagtccgtagaacggtacgaacgggtacgttagtaaccttacgtacggtaacggaagggggacgggggaaccgaagggcggggtaacgttaccgaacggttaccgttaaccgtttcggtaaccggg

SEQ ID NO: 332253 - DNA, 682 bp, Homo sapiens
  misc_feature: GZ8MTXP01EFC69.8.34.D01.1.454.CMB.2.raw
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggagtcacagagactctcgtgtgcagcctcgtgggttcaccttcagtaactacggcatgcacgtcgggccnccaagcctccgaggcaagggnttgggagtgggtggctagtttgttcatcgtggagggtctagtgttacaaagttgggtaatgacgaaggtaccttaccgggtagggaaacggggtcccgtaattccaacctatcctaccgaagaacgtaacctaacttaccgaaacggaaaccaactaaagttagttaagtttacgggaacgtactacggaaactacgtaccgtaacgtacccgtaggtaacggaccgtaccgggtcgttaactaacgttaacgtacgggttaaaccgggaaagggggaacggggggaaaccgacggggaccggggtaacgttaccgtaacggttaccttccggtttacggtaaccggttcggtaaccggggg

SEQ ID NO: 332254 - DNA, 717 bp, Homo sapiens
  misc_feature: GZ8MTXP01C32DV.8.34.D01.1.454.CMB.2.raw
  modified_base (287)..(287): a, c, t, g, unknown or other
  misc_feature (287)..(287): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgtcttcttttaagaggtgtccagtgtcaagtgcaacgtgggtggagtcgtgggggaggcgtggtccagccgtggggagtcacagagactctcgtgtgcagcctcgtggttcaccttnagtaactacgcatcgcacgtgggtcccaccaagcctaccgaggacgaaggggtatttgggaggttggggtcggctaggtttcgtttccagttcgtggacggggctaaaggttgttaacaaagttcgggtaatggacaacggtaccgtccgggtaggaacgggccgtaacttccaaaccctattaccgtacccgtaaaggaacgaacctaaacttacccgaaacgggaaacctaaacgtaaagtttacggttaagtttacgggaacgtaccgtaacggaaactaaacggtacccgtaaaggtcccgtagggaaacgggtaacccgaacgggggttacttaaacgttacgttaacgtacggttaacgggaaagggttacgggggtaacgaaccgaagggtaccgggtacttaccgtaacgttaacgttccgg

SEQ ID NO: 332255 - DNA, 732 bp, Homo sapiens
  misc_feature: GZ8MTXP01AV35V.8.34.D01.1.454.CMB.2.raw
  modified_base (311)..(311): a, c, t, g, unknown or other
  misc_feature (311)..(311): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagccgtgggaggtcacagagactctcgtgtgcagcctcgtggttccaccttcaagtaactacggcatgcacgtggtccncaagctccgaggcaagggattggagtgggtgctaggtttgtttcccattcgtggaggggctaaggttgttaacaaagttgggtatggaccgtaaggaccgttccggtaggaaacggggtcccgtaagttcccgaaccctaacgttacctacccgaaaggaacgaaaccgtaaacgtttacccgaaacggtaaaccaaacggtaaagttaggttaaagtttaggggaacgtacgttacgaaaccgtaacgtaccccgttaaaaggttccccgtaaggaaccgggaaccgggtaaccgggttacggttaaacgttaaccggtaaaccgttaaggggttaaacccgggaaagggggaacggggggaaacccgagggtaaccgggtaacgttaccggaaacggttaaccgtttccgtttaacggg

SEQ ID NO: 332256 - DNA, 572 bp, Homo sapiens
  misc_feature: GZ8MTXP01CH8G8.8.34.D01.1.454.CMB.2.raw
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
  modified_base (452)..(452): a, c, t, g, unknown or other
  misc_feature (452)..(452): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgttggcgcctacgtatcctggtaccaacagaaacctggccaggcctcccgacggccccctnatcctatgggtncatcccaaacgcggggcccacgtcggaccactccccgagccaggttcaggtcggcaggtgggtatggggaacagtcttcactctcaccatcatcagccgtgacnctgagtatgtncttagtttatacgtgtacaacgtntccgtacggagttcggcccggttccgggggcctacgttccgggccctaggggaacctaaaggtggacttacgacgaaaacgtacttggcgctgcaaccgtatcttacgttccttctaacc

SEQ ID NO: 332257 - DNA, 588 bp, Homo sapiens
  misc_feature: GZ8MTXP01EZHSS.8.34.D01.1.454.CMB.2.raw
  modified_base (396)..(396): a, c, t, g, unknown or other
  misc_feature (396)..(396): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagcccaccctctcctgcagggccagtcagaatgttggcgcctacgtatcctggtaccaacagaaacctggccaggctcccaggcccctcatctatggtgcatccaacagggccactggcatcccagccaggttcagtcggcagtgggtatgggaacagcttcactctcaccatcatcagcctggancgtgagatgtgctagtttattacgtgtacaacgtatccgtacgagtccggacccgtccgggggaccctacgttccgggacccgtcgggaacctaaagggttcggaacgttaacttaccgtaaaacggtaacgttggttcgggttaccttcggacctaaccccgtaattccgttggttcccttttgaaccccg

SEQ ID NO: 332258 - DNA, 575 bp, Homo sapiens
  misc_feature: GZ8MTXP01AZR15.8.34.D01.1.454.CMB.2.raw
  modified_base (315)..(315): a, c, t, g, unknown or other
  misc_feature (315)..(315): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcgtgtgcagcctctgggttcaccttcagtaactacggcatgcactgggtccgccaagctccaggcaagggntggagtgggtggctagttgttcatccgtggagggcagtgttacaagtggtatgcagactcgtgacgggcgatcacatctcaganacatcagacanaatgtagttgagctagaacagtactaacgtccgtaggaacggtacgaacgggtcgttaattaaccgtacgttaggtaaacgggaaacgggggttaacgggggaaccgacggggaacggggtacgttaaccgaaggttaccttccggtttaagaacggttccgggg

SEQ ID NO: 332259 - DNA, 796 bp, Homo sapiens
  misc_feature: GZ8MTXP01B142U.8.34.D01.1.454.CMB.2.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagcctcgtggtcactcagtaacncggcatgcactggcccncaagctccgaggcaagggnttgggagtggggtgctaggttgtttcagtcgtggagggctaggttgttacaagttgggtaatcggacgtaacgggtaaccgttcccgggtaagggaaacgggggtcccgtaacgtttacccgaacccgtaacttcccgttaaccccgaaagggtaaacggtaaaccctaaacgtttaccccgaaagggaaaacctaaaccgtaaaaggtttacggttttaaacggttttaggggaacgttaccgttaacggaaaacccgtaacggtaaccccgtttaaacgggttccccgttaagggaaccggggtaaaccggaaccgggggtactttaaacggttaaaccgttaaccggttaaacggggttaaacccggggaaaggggggaaaccgggggggaaaaccccgaaggggtacccgggggttaaaccggtttaacccggtaaaacggtttacccgtttaacccggtttttaacggggtaaccccggg

SEQ ID NO: 332260 - DNA, 557 bp, Homo sapiens
  misc_feature: GZ8MTXP01DQBKC.8.34.D01.1.454.CMB.2.raw
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
  modified_base (402)..(402): a, c, t, g, unknown or other
  misc_feature (402)..(402): n is a, c, g, or t
  modified_base (516)..(516): a, c, t, g, unknown or other
  misc_feature (516)..(516): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgtgcagcctcgtgggtcacctcagtaactacggcatgcacgtgggtcccncaagcctccgaggcaaggggtnttgggagtggggtgctagttgttcatcgtggaggctagtgtacaagtgtatgcagctcgagaggcatcacntcacagagacatacaagaacactagtgttagttggatctagaacacgtacctaagtccgtaggacggacgaacgggtcttatacttagtaggtaacggaagggacggggaacgngggacggtaacgttaccgagttaccgttcgttggtaaccgg

SEQ ID NO: 332261 - DNA, 709 bp, Homo sapiens
  misc_feature: GZ8MTXP01C0CR9.8.34.D01.1.454.CMB.2.raw
  modified_base (336)..(336): a, c, t, g, unknown or other
  misc_feature (336)..(336): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtggggggaggcgtggtccagccgtggggaggtcacagagactctcgtgtgcagcctcgtggttcacctcagtaactacggcatcgcacgtcgggcccaccaagcctccgaggcgaagggtnttgggagtggggtgctagtttgtttcagtcgtaggagggtctaggtgttacaagttgggtaatggacaaggtaccgtccgggtaagggaacggggtcccgtaattacccgaacctaacgttacccgtacccgaagtaaacggtaaacctaaacgttacccgaaagggaaacctaaacgtaaaggttaggtttaagtttaggaacgtacgtaacgaaacgtacgtacccgttaaacggtcccgtaggaacggaaccggtaacggggtacgttaaagtaaccgttaacggtaacgggtaaacgggaaagggggacgggggaaccgaagggaccgggtaacgttacccgaaggttaccttcggttcggtaaccggg

SEQ ID NO: 332262 - DNA, 771 bp, Homo sapiens
  misc_feature: GZ8MTXP01CVVZK.8.34.D01.1.454.CMB.2.raw
  modified_base (301)..(301): a, c, t, g, unknown or other
  misc_feature (301)..(301): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagccttcgtgggttcaccttcaagtaactacggcatgcacgtcgggccncaagcctccgaggcaagggtattgggaggtgggtgctagtttgttcatcgtaggaggggtctaggttgtacaaaagttggtaactcggacaacggtaccgtaccggtagggaaacggggtccctatttccaaccaattccgaccgaagtaacgtaacctaaacttacccgaaaggaaacctaaacgtaaagtttaggtttaacggtttaggggaaacgtaccgttaagggaaacctaaccggtacccgtttaaacgggtaccccgttaaggggaaccgggtaaaccggacccggggggtaacttaaacgtaaaccggttaacggttaaacggggttaaaccggggaaaaggggggaaaccggggggttaaaccccggagggggttaacccgggggttaaacgttaacccggtaaacggtttacccgttacccggttttacggggaaccccggttcgggttaaccgggggg

SEQ ID NO: 332263 - DNA, 698 bp, Homo sapiens
  misc_feature: GZ8MTXP01DXWWB.8.34.D01.1.454.CMB.2.raw
  modified_base (314)..(314): a, c, t, g, unknown or other
  misc_feature (314)..(314): n is a, c, g, or t
  modified_base (340)..(340): a, c, t, g, unknown or other
  misc_feature (340)..(340): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtggggagtcacagagactctcgtgtgcagcctcgtggttcaccttcagtaactacggcatgcacgtcgggtcccnccaagcctaccgaggcgaaaggggtnttgggaggtggggtggctaggtttgtttccagttcgtggacggctaagttgttcaaagttgggtatgacgaggtaccgtccggtaggaacgggcctagttaccacctatcctaccgaagaacgaactaacttacccgaaaggtaaaccaacgtaaagttaggtttaacgtttagggaacgtacgttacggaaaccgtaacgtacccgttaaacggttacccgtagggaacggaaccggtaacggggttacgttaaacttaccgtaacgtaacgggttaaccgggaaagggggaacggggggaacccgtaagggccgggtaacgttaccgttaacgttaacccgttccggtttaacggg

SEQ ID NO: 332264 - DNA, 627 bp, Homo sapiens
  misc_feature: GZ8MTXP01A0IUM.8.34.D01.1.454.CMB.2.raw
  modified_base (315)..(315): a, c, t, g, unknown or other
  misc_feature (315)..(315): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacngggcccactggcatcccagccaggttcagtcggcagtgggtatgggaacagcttcactctcacatcatcagcctgggacnccggggggtanaggtagttgttcgtacgttagtttaacttacgtcgtacgtaaacgtacgttaccggtaccggtacggtccgggtaccccgggttcccgggggtacccttacccggtttcccgggacccggtacggggaaaccgtaaagggtcggttaacgtaacgttaacgaaacgtaacgttgggttcggcgtcgacctaaccgtacgttcgttacgttccgttctaacg

SEQ ID NO: 332265 - DNA, 657 bp, Homo sapiens
  misc_feature: GZ8MTXP01EE4U3.8.34.D01.1.454.CMB.2.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanacgccaccctctcctgcagggccagtcagatgtggcgctagtatcctaggtaccaacagaacctggccaggcctcccacggcccctnactctatggtcgcactcccaacgaggggcccacgtggcctactccccgagcccgtaggttccaggtacggctaggtgggtatgggaacagtctcactcacacctatcatcacgtcctaggactccgtaggaacggtgttgtacgacttagttttaactaacgttcggttaaccaaactacggttaccggtaaccgggttaggtcccgggccccgggttacccgggggtcccttaaccgggttttcccgggacccggttacggggaaaccgtaaaggtgggaacttaacgttaaccgaaacggtaacgttggttacggttacgtcggactaacccgtattccgttgttcccttcgtaaccc

SEQ ID NO: 332266 - DNA, 551 bp, Homo sapiens
  misc_feature: GZ8MTXP01AQ20Q.8.34.D01.1.454.CMB.2.raw
  modified_base (296)..(296): a, c, t, g, unknown or other
  misc_feature (296)..(296): n is a, c, g, or t
  modified_base (510)..(510): a, c, t, g, unknown or other
  misc_feature (510)..(510): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccnccaagctccaggcaaggggattgggagtgggtggctagttgtttcattcgtggaggggcaggtgttcaaaattgggtaatgcagactccggtgaacgggccgtatcacatctccagagacatcagacacaatgtagttgagctagaacagcctaagtcctgaggacacgggctaataacgttacgtcggttacggaaagggacgggggaaccgnggacgggaagtaccgaagtactcgttgaacgttcgtcgggg

SEQ ID NO: 332267 - DNA, 553 bp, Homo sapiens
  misc_feature: GZ8MTXP01COTBZ.8.34.D01.1.454.CMB.2.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (455)..(455): a, c, t, g, unknown or other
  misc_feature (455)..(455): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccncaagctccaggcaagggnttggagtgggtgcagttgttcatctgagggcagtgtcaaattggtaatgcagactccgtgaagggccattcaccatctcagagacaatccagaacacaatgatttggagctagaacagcctaagtcctagaggacacgggngtaatacttacgtaggacggaaaggggagggggaacccgaggaccggggtaagttcccgaaaggtccgttacgtttaggtaaccgttcgtaacggggg

SEQ ID NO: 332268 - DNA, 552 bp, Homo sapiens
  misc_feature: GZ8MTXP01C2XD3.8.34.D01.1.454.CMB.2.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (379)..(379): a, c, t, g, unknown or other
  misc_feature (379)..(379): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctgggaggtcacagagactctcgtgtgcagcctctggttcacctcagtaactacggcatgcatgggcccncaagctccaggcaagggnttgggagtggggtgctagttgtttcatcgtggagggctaggtgttacaagtggtatgcagactcgngacggcgatcacatctacagagacaattccaaggaacacaagtgtagttggagctagaacagacctagtcctagacggacgaacgggtcgttagtacttacgtaggtaacggaaggggacgggggaaccgaagggacgggtaacgtacgaacgttaccttccgttgtaaccgg

SEQ ID NO: 332269 - DNA, 677 bp, Homo sapiens
  misc_feature: GZ8MTXP01BCLAB.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacgagagactctcgtgtgcagcctgtcggttccaccttcagtaactacggcatgctacgtcgggtcccaccaaagcctaccgagggcgaaagggggtattggggaggttgggggtagcgtagtttcgtttcagttcgtggaggggtctaaggttgttacaaaagttgggtaatcggaccgaaaggtacccgttccgggtaggaaacggggtcccgtacttaccacctactcctacccgaaggaacgtaactaaacttaccgaaggaaaccaacgtaagtagttagtttacggagtcctagaacacgtaccgtaagtccgtagacggacgaccgggtctaagtaacgttacgtaggttaaacggaaacggggaacgggggaaccgagggttacgggtaacttaccgtaacgtacgtccgttacgaacggttcggtaaccgggg

SEQ ID NO: 332270 - DNA, 654 bp, Homo sapiens
  misc_feature: GZ8MTXP01AK43R.8.34.D01.1.454.CMB.2.raw
  modified_base (296)..(296): a, c, t, g, unknown or other
  misc_feature (296)..(296): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcgtgtgcagcctcgtggttcacctcagtaactcggcatgcacgtggtcccncaagctccgaggcaagggattgggagtggggtgctagttgtttcattcgtggaggggtctaggttcgttcaagtgggtaattggcttggaccggtccgtgggaacgggtccgacttccgacctatcctacccagacgacaactaccgaaggaacaactaaacggttgttaacgttttacgggaacccttacgaaaccgacggtacccgttaaacgtccccgttaggaacgggtaccgtacgggggtaattaacgttacgttaacgttacgggtaaaccgggaaggggacgggggaacccgagggaaccggggtacgttaaccgaaacgttaccgttaccgttcgttaaccggtccggg

SEQ ID NO: 332271 - DNA, 606 bp, Homo sapiens
  misc_feature: GZ8MTXP01D9F1S.8.34.D01.1.454.CMB.2.raw
  modified_base (341)..(341): a, c, t, g, unknown or other
  misc_feature (341)..(341): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggagtcacagagactctcgtgtgcagcctctggggttcaccttcagtaactacggcatgcacgtggtccgccaagctccaggcgaaggagtggagtgggtggcgtagtttgttnatcgtgagggcagtgttacaaagttggtaagtgcgatacgtccgtaggaacgggccgtattcaccactctcagagactaactaccaaggaacaacaattcgtagtttaggagactagaacacgcgtaacgtaccgtgaaggtacgacggggtacggtaattaacgttacgtacggttaaacggaaagggggaacgggggaaccgagggacggggtaagttaccgaacgttaccgtcgtttacgtaacggttcggttaaccggggg

SEQ ID NO: 332272 - DNA, 703 bp, Homo sapiens
  misc_feature: GZ8MTXP01DRC83.8.34.D01.1.454.CMB.2.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (631)..(631): a, c, t, g, unknown or other
  misc_feature (631)..(631): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctgtgggttcaccttcaagtaactacggcatgcacgtcgggtccnccaagctccaggcgaagggnttgggagtggggtgctagttgtttcatcgtgaggggtcagttgttacaaaagttgggtaatcgacgtaacggtaccgttacccgggtagggaaacggggcccgtatttaccgaacctaactcctaccgaaagaacgtaacctaaacttcccgaaaggaaaccaaactaaagttcgtttaaggtttcgggaagtaccgtagaaaccgacggtaccttaaaggttcccgtagggtaacggtacggaaccggggtcgttaaactaccgttaacgtagggttaaacgggaaagggggtaaccgggggaaacccgnggggaacgggttaacggttaacccgaaagggtttccctccggttttacgggccggttcggggttcccggggg

SEQ ID NO: 332273 - DNA, 588 bp, Homo sapiens
  misc_feature: GZ8MTXP01AXVEC.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcataccaacaggggccacttgcatccccagccaggttcagtcggcagtgggtatggggaacagcttcactctcaccatcatcagcctggacgcctgaggattggttgctagtttaattactgtcaactagttcgtaccggtagtcgggtcccgtcccgggggaccctacgtttcccggccccgttacggggaaccctaaaaggtcgggttaactaacgttaccgaaaacggaaccttaggttcggacgttggcaacccatcttacgttctttccgtaaccg

SEQ ID NO: 332274 - DNA, 676 bp, Homo sapiens
  misc_feature: GZ8MTXP01BUPF9.8.34.D01.1.454.CMB.2.raw
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcncctagtatcctggtaccaacagaaacctggccaggctcccaggcccctanactctagtggnacactaccgaacgacgggcccacgtcggacctactccccgacgtccgtaaggttcaggtcggacgtagggttgggtagtgggaaaccagtccttcactctacacctatacactcacgccgtggacgtccgtaggaaggttattggttcgacttaagttttacttacgttacgttaaccgaaacgttacgttacccggtaaccggtacggtccgggtccccggttacccgggggtacccttacccggtttcccgggacccggtacggggaaaccctaaagggtcggttaaacttaacgttaaaccgaaaccgtacgttacggttcggccgtaacgacctaaccgtacgtccgttcgttccttcgtaaccg

SEQ ID NO: 332275 - DNA, 621 bp, Homo sapiens
  misc_feature: GZ8MTXP01A5WES.8.34.D01.1.454.CMB.2.raw
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
  modified_base (572)..(572): a, c, t, g, unknown or other
  misc_feature (572)..(572): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtggggagtcacagagactctcgtgtgcagcctgtggtcacctcagtaactacggcatgccacgtgggtcccnccaagcctccgaggcgaaggggtnttgggagtggggtgctagttgttcatctggaggctagttgttacaagtggtatgacagtacctcggtagacgggcctatcaccgtatcgtaccagacactaatcccgaaggaactaacaagttagttaagtttagggacgtacgtagaaccgagtaccctaaggtcccgtaggacggtaacgaacggggtacttaagtaaccgttacgtaacggtaacgggaaggggttacgggttacggaaacccgngggaaccgggttaacgttaccgttaacggttccgttccgtttaacgggg

SEQ ID NO: 332276 - DNA, 579 bp, Homo sapiens
  misc_feature: GZ8MTXP01COBIE.8.34.D01.1.454.CMB.2.raw
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (565)..(565): a, c, t, g, unknown or other
  misc_feature (565)..(565): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgtggcncctacgtatcctggtaccaacagaaacctggccaggctcccaggcccctnatctatggtgcatcccaaacgagggcccacgtggccatccccagccaggttcagtcgcagtgggtatgggaacagcttcactctcaccatcatcagcctggacgcctggaggtattggttacgtactagttttacttacgttcggttacaacgtacgttccgttaaccggaggttccgggacccggtccgggggccctaccgtttccgggacccgtcggggaaccaaggtggactacgttacgaaacgtacgttggcgttctgcaaccntcttcgtcttcgtc

SEQ ID NO: 332277 - DNA, 641 bp, Homo sapiens
  misc_feature: GZ8MTXP01BGNAR.8.34.D01.1.454.CMB.2.raw
  modified_base (298)..(298): a, c, t, g, unknown or other
  misc_feature (298)..(298): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgcacgtcgggtccnccaagcctccgaggcaagggattgggagtggggtgctagtttgttcagttcgtggaggggctaggtgttcaaaagttgggtaatggacctaggactccggtaggaaacggggcccgtattcaccatctaccagacgaactaattaccgaaggtaaacaacaattgttaggtttggagcctagaacagtacctaagtcccgtaggaacggtacgacggggtacgtaacgtacgttaacgtacgggttaaccgggaaaggggaacggggggttaaccgacgggacgggggtaacgttaccgaagttacccgttaccgttacggtaaccggttcggtaaccggggg

SEQ ID NO: 332278 - DNA, 841 bp, Homo sapiens
  misc_feature: GZ8MTXP01B4NC5.8.34.D01.1.454.CMB.2.raw
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggttcaccttcagtaactacggcatgcacgtcgggtcccnccaaagcctccgaggcaagggnttgggagtggggtggctaggtttgtttcatcgtggaggggtctaggttcgttacaaagttgggtaatcgacgtaggaccgttccgggtagggaaacggggtccccgtaactttacccgaacccgtacttacccgtacccgtaaacggtaacgtaaacccgtaaaacgtttaccccgaaaagggaaaaccctaaacgtaaacgtttacgggtttaacggttttaagggggtaacggtacccgttaacggaaacccgtaacggtaaccccgttaaacggttacccgttagggtaaaccgggggtaaaccggtaaccgggggtaccggttaaacgttaaacccgttaaaccgggttaacggggttaaaaccgggggtaaaacggggggtaaacgggggggggttaaaccccggaacgggggttaccggggggttaaaccgggtttaccccggtaaaacgggtttaaccccgttacccggtttttaccgggtaacccggggtttcccgggttaacccggggggg

SEQ ID NO: 332279 - DNA, 640 bp, Homo sapiens
  misc_feature: GZ8MTXP01DRMJP.8.34.D01.1.454.CMB.2.raw
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagctctgtgtgcagcctcgtggtcacctnagtaactacggcagtgcacgtcgggtcccnccaagcctccgaggacgaagggtnttggggagtggggtgctaggtttgttcatcgtaggagggtcagttgttacaagtgggtaatgcgacgtacctccgggtaggaacgggtccgtattccgaacctatcctaccaagaacgaacaacttaccgaaggaaacactaaagttgttaagtttaggaagtacgtagaaccgtacgtaccgtaacgtcccgtaggacggaccgaacgggtacgttaacgtaacgttacgtaacgggtaaccggaaaggggaacgggggttaaccaacgggacgggtaacgttaccgaacgttaccgttccgtttggtaacccggg

SEQ ID NO: 332280 - DNA, 624 bp, Homo sapiens
  misc_feature: GZ8MTXP01A8R3F.8.34.D01.1.454.CMB.2.raw
  modified_base (300)..(300): a, c, t, g, unknown or other
  misc_feature (300)..(300): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgagggaaagacgccaccctctcctgcagggccagtcagatgtgcgcctagtatcctagtaccaacagaaacctggaccaggcctccccgacggccccctnatctagtggtgcactccaacgtgggcccacgtggacactccgagccgaggttcaggtcggctaggtggggtatggggaaacaggtcctttcgactcacactatcatcagccgtggacgccgtggaggtattgttgacgttagttttacgtacgtgtactaaacgacgttccgtacgtcggtcgggtccccggttccgggggccccttaaccgggtttcccgggacccggttacggggaacccgtaaaggtcggttacgtaaacgttacgaaaacggtacttggttcggctaacggcctaacgtacttcgttctcctttcgtccg

SEQ ID NO: 332281 - DNA, 688 bp, Homo sapiens
  misc_feature: GZ8MTXP01CGET3.8.34.D01.1.454.CMB.2.raw
  modified_base (328)..(328): a, c, t, g, unknown or other
  misc_feature (328)..(328): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctcgtgtgcagcctcgtgggttcaccttcagtaactcggcatgcacgtgggtcccaccaagcctaccgagggaccgaaaggggtnttgggaggttgggggtggtcgtaggtttgtttcagttccgtgggagggtctaggttgttaacaaagttgggtatcgggactagaccgttccgggtaggaacggggccgtagttaccacctatcctacccgaagacgaactaacgttaccgaacggaaactaacgaagtttagggttaagttttagggaacgtacgtagaaaccgtacggtaccttaacggtccgtagggaacggaaccggaacgggtaacgttaaagttaccgtaacgttacgggtaaacgggaaggggacgggggaaccgagggtaaccggggtaacgttccgtaacggttaccgttaccgtttcggaacggttccggg

SEQ ID NO: 332282 - DNA, 564 bp, Homo sapiens
  misc_feature: GZ8MTXP01EPWCV.8.34.D01.1.454.CMB.2.raw
  modified_base (515)..(515): a, c, t, g, unknown or other
  misc_feature (515)..(515): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagtaggtgtccagtgtcaagtgcaactggtggagtcgtgggggagggcgtggtccagccgtgggaggtcacagagactctcgtgtgcagcctctgggttcaccttcagaactacggcatgcactgggtccgccaagctccaggcaagggattggaggtgggtggcagtttgtttcatctggagggcagtgttcaaaagtggtaatgcgagtactccggtggaacgggccgtattcaccatctccagagacaatcagaacaacatagtagttgagctagaacagactaagtcctgagacgacgggcgtaatacttacgtaggttacggaaaggggacgggggaaccgnggacggggtaagtacctaaggtacctcgttacgtcggttcgtccggggg

SEQ ID NO: 332283 - DNA, 587 bp, Homo sapiens
  misc_feature: GZ8MTXP01A99KZ.8.34.D01.1.454.CMB.2.raw
  modified_base (210)..(210): a, c, t, g, unknown or other
  misc_feature (210)..(210): n is a, c, g, or t
  modified_base (560)..(560): a, c, t, g, unknown or other
  misc_feature (560)..(560): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccaccctctcctgcagggccagtcagaatgtggcgcctacgtatcctggtaccaacagaaacctggccaggctcccaggcccctcatctatggtgcatcccaaacgacggggccccaacgtggaccaactcccccgagcccagggttccaggtcggcagggtggggtaatgggggaaaccaggtaaccttcacctctaccaacccatcatcagcctggacgcctggaggattggttgcgttagtttacttacttgtacaactagttccgtacgtagtcggcccgtccgggggtcctacgttccgggccctggggaccaaaggtcggatacgttacgaaacgacgttgnggctaagcaacctatcttcgtcttctc

SEQ ID NO: 332284 - DNA, 803 bp, Homo sapiens
  misc_feature: GZ8MTXP01BNXOV.8.34.D01.1.454.CMB.2.raw
  modified_base (295)..(295): a, c, t, g, unknown or other
  misc_feature (295)..(295): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctctgggttcaccttcagtaactcggcatgcacgtgggtccnccaagcctccgaggcgaagggattgggagtgggtggctagtttgttcattcgtaggaggggtctaggttgttactaaaagttgggttaatggaccgtaaaggtacccgttccgggtagggaaacgggggtcccgtaacgtttccaaccctactccgtacccgaaggtaaacgaaccgtaaacgtttacccgaaacggtaaaccaacgtaaaagttaggtttaaggttttaggggtaaacggtaccgttaacggtaaaccgaaccggtaaccccgttaaacggttaccccgttaagggtaaccgggaaaccggtaaccgggggtaacccggttaaagttaaacccgttaaaccgggtaaacgggttaaaccgggggtaaaagggggtaaaccggggggggttaaaaccggacgggggttacccgggggtaacggtttaaccccggtaaaacggtttacccggtttaccggttttacgggtaaccgggtttaaccgggtaacccgggggg

SEQ ID NO: 332285 - DNA, 817 bp, Homo sapiens
  misc_feature: GZ8MTXP01B89YQ.8.34.D01.1.454.CMB.2.raw
  modified_base (323)..(323): a, c, t, g, unknown or other
  misc_feature (323)..(323): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtggggagtcacagagactctcggtgtgctagcccttcgtcgggttccaccttcgagtaactacggcagtcgcacgtcgggtcccnccaagcctaccgaggaccgaaagggggtagtttggggaggttggggtggcgttaggtttcgttttacccagttcgtagggacgggtcctaaagggtttggttaacaaagttggggtatcggacgtaaccggtaccgttacccgggtacgggaaaccggggtacccgtaacgttacccgaaccctaacgttacccgtaacccgaacggtaaaccggtaaacctaaaccgtttaaccccgaaacggggaaaaccctaaacggtaaacgtttacgggttaaacgttttaggggaaacgtaccgttacggaaaaccgtaacgttacccgtaaacggttcccgtacgggaacgggtaaccggtaacggggttacgttaaacgttaaccgttaacggtacgggttaaacgggaaacgggggaacggggggaaacccgtaggggtaaccgggttaacggttacccggttaaacggtttccgtttaaccggttttaaccggg

SEQ ID NO: 332286 - DNA, 594 bp, Homo sapiens
  misc_feature: GZ8MTXP01AE7TA.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgttggcgcctagtatcctggtaccaacagaaacctggccaggcctcccaggccccctcactctatggtcgcactccaaacgaggggcccacgtggcaactccccagccaggttcaggtcggcaggtgggtatggggaaacaggtcttcactctacaccatcatcagcctggacgcctggaggtatgttgctagtttatactgtacaacagttcgtaccgagtcggtccgtccgggggtccctacgttccgggcccgtacgggaaccctaaagggtcggttaactaacgttaccgtaaaacgtaacgttggttacggcttcggactaaccgtactcgttcgttcttccgttaacc

SEQ ID NO: 332287 - DNA, 579 bp, Homo sapiens
  misc_feature: GZ8MTXP01BL7IH.8.34.D01.1.454.CMB.2.raw
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (446)..(446): a, c, t, g, unknown or other
  misc_feature (446)..(446): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagtctggggaggtcacagagactctcgtgtgcagcctcgtgggttcaccttcagtaactacggcatgcactggggcccnccaagctccgaggcaaggggnttgggagtggggtgctagttgttcatctggaggggcagtgttcaagtggtatgcagactcggtgaaggcgattcacatctaccagacgacaacttccgaaggaacacaagtgttatttagggancgtagaacacgtacctaacgtcctaggacggacgaacgggtgttactacgttacgtaggtaacgggaaagggggcgggggaaccgaagggacggggtaacgttaccgaacgttacgttccgtttggaaccggg

SEQ ID NO: 332288 - DNA, 727 bp, Homo sapiens
  misc_feature: GZ8MTXP01A3V3U.8.34.D01.1.454.CMB.2.raw
  modified_base (305)..(305): a, c, t, g, unknown or other
  misc_feature (305)..(305): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgttggcgcctacgtatcctaggtaccaacagaaacctggacccaggcctcccgacggccccctnactctagtggtgcactcccgaacgacgggcccacgtggaccactccccgagccgtaggttcaggtcggacgtagggtggggtaatcgggggaaacaggtcctttcaaccttcctaccaacctatccaactcgacgtcccgtagggacgtccgtagggaagggtattggttacggtaccgttaagttttaacttacgttacgtacctaaacgtacgttaccgggtaacccggtagggttcccgggtaccccgggttaccccggggggtaccccttacccgggttttcccggggaccccggttacgggggaaacccgtaaagggttcggttaaacgttaacgttaaccgaaaacggtaaccgttgggttcgggccttaacggaccctaacccgttcgttccgttacgttcccgttaaccgtccg

SEQ ID NO: 332289 - DNA, 692 bp, Homo sapiens
  misc_feature: GZ8MTXP01AXDKD.8.34.D01.1.454.CMB.2.raw
  modified_base (312)..(312): a, c, t, g, unknown or other
  misc_feature (312)..(312): n is a, c, g, or t
  modified_base (391)..(391): a, c, t, g, unknown or other
  misc_feature (391)..(391): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtggagtcacagagactctcgtgtgcagcctcgtgggttcaccttcagtaactacggcatgcacgtcgggtcccnccaagcctaccgaggcaaggggtatttgggaggtcggggtgctagtttcgtttccattcgtggagggctaagttcgttnaaagtgggtatgggcaggtactccggtagaacgggcccgtattccaacctatacctaccgaaggacaactaaacttacccgaaaggaaacctaacgtaaagttaggtttaacgtttagggaatccgtaagaactaacggtacccttaaacgggtccctaagggaacgggaaccgaaccgggggttaccttaaagttaacccgtaaacgtaagggttaaaccgggaaagggggaacgggggaaaccccgaggggaaccggggtaacgttaccgaaacggtttccttaacccggttttaaggg

SEQ ID NO: 332290 - DNA, 723 bp, Homo sapiens
  misc_feature: GZ8MTXP01EIE05.8.34.D01.1.454.CMB.2.raw
  modified_base (332)..(332): a, c, t, g, unknown or other
  misc_feature (332)..(332): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctgtgggttcaccttcagtaactacggcatgcacgtgggtcccgccaagcctccgaggcaaaggggnttgggagtgggtgctagtttgtttccatcgtggaggggtctaaggttgttcaaagttggggtaatggacctaaggtacgttcccggtaggaacggggcccgtattccaacctataccctacccaaggaacgaaccaaacttaccccgaaagggaaacctaacggtaaagtttaggtttaacgtttagggaaggtaccttaacgaaaccgaacggtacccgttaaacggtcccgtagggaacggggaaccgtaaccgggggaccgttaaagttaaccgtaacggttacgggttaaaccggggaaagggggaacgggggggaaaccccgtaaggggaaccgggggtaacggttacccgttaaacggttaacccgtttaaccggttttaacggg

SEQ ID NO: 332291 - DNA, 559 bp, Homo sapiens
  misc_feature: GZ8MTXP01CY4ZO.8.34.D01.1.454.CMB.2.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcgtgtgcagcctctggtcaccttcagtaactacggcatgcacgtggtcccncaagctccgaggcaagggnttggagtgggngctagttgttcatcctggaggctagtgttacaatggtatgacagactcgtagaacgggcgtatcacatctacaagacgacaactaccaagaacaactaatggttaatttaggaacacgtagaacacgacctaacgtccgtagacggacgaacgggaactaacttacgtacgaggtaacggaagggacgggggacagggaacggagtaacgaacgtcttcgttaacgcgtaacgg

SEQ ID NO: 332292 - DNA, 604 bp, Homo sapiens
  misc_feature: GZ8MTXP01A1VQE.8.34.D01.1.454.CMB.2.raw
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtggtcacctcagtaactacggcatcgcacgtcgggtcccnccaagcctccgaggcaaggggnttgggaggtggggtggctaggtttgttcagtcgtggagggctagttgttcaagtggtatgcagactcgtagacgggcgtatcacctatctaccagacgactaacttaccaaggaactacaagttagtacgtttggagtactagaacacgtacctaagtccgtaggaacggtacgaacgggtacgttacgtacgttacgtacggtaacgggaaggggacgggggaaccgaagggtacgggtaacggttaccgtaacggttaccgttccgttaacggtaaccggg

SEQ ID NO: 332293 - DNA, 679 bp, Homo sapiens
  misc_feature: GZ8MTXP01CS6Z5.8.34.D01.1.454.CMB.2.raw
  modified_base (171)..(171): a, c, t, g, unknown or other
  misc_feature (171)..(171): n is a, c, g, or t
  modified_base (306)..(306): a, c, t, g, unknown or other
  misc_feature (306)..(306): n is a, c, g, or t
  modified_base (610)..(610): a, c, t, g, unknown or other
  misc_feature (610)..(610): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtggtccagccgtgggaggtcacagagactcgtcgtgtgcacgtccctcgtgggttccaccttcagtaactacggcatgcacgtcgggtcccncaagctccgaggcaaggggattgggagtgggtgctagtttgttcagtcgtggagggtctagtgttacaaaagttggtaatggactaagggtacctccggtagggaaacggggtcccgtatttaccaccctaatcctaccgaagaacgaacctaaacttaccgaacggaaactaactaaagttaggtaggtttaggacgtactacgaaacgtacgtaccgtaaggttccgaggtaacgggacgtaccgggacttaacgtaacgttagttacggaaacggggaaacgggggacgggggaaacccgnggggttaccggggtaagttacccgtaacggttaccgttccgttaggtaaccggttcggtaacccggggg

SEQ ID NO: 332294 - DNA, 590 bp, Homo sapiens
  misc_feature: GZ8MTXP01BZQBD.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagcctgggaggtcacagagactctcgtgtgcagcctctgggttcacctcagtaactacggcatgcacgtgggtccgaccaagcctccgaggcgaaagggggtattgggaggtggggtggcgtaggtttgtttcagtcgtggagggctagtgttacaagtggtatgcagctcgagaggccgagttcaccatctaccagacgacaacttccaaggaacactaagttgtaagtttggagtactacgaacacgaccttaacgtcccgtaggtacggacgaacgggtcgttaagtacttacgtaggtaacggaaggggacgggggaacaagggacgggtaacgtaccgacgttactccgttcggtaaccggg

SEQ ID NO: 332295 - DNA, 666 bp, Homo sapiens
  misc_feature: GZ8MTXP01CF055.8.34.D01.1.454.CMB.2.raw
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctctgggttcaccttcagtaactacggcatgcactgggtcccnccaaagctccaggcaaggggnttggagtggggtgctagtttgtttcagtcgtaggaggggctaggtgttcaaaagttgggtaatggacaaggtactcccggtagggaaacggggcccgtattaccacctaatccgtacccgaaggaacgaacctaaacttaccccgaaagggaaaccaacgtaaattgttaaggtttagggaagccttaaggaaacctacgacccgttaagtcccgtaggtacggacgacggggtctaagtacttacgtacgggttaaccggaaaggggacgggggaaacccgaggggttacgggtaacgttcccgaaaggttccgttaccggttaggtaaccggttcggtaaccggggg

SEQ ID NO: 332296 - DNA, 675 bp, Homo sapiens
  misc_feature: GZ8MTXP01CLCYE.8.34.D01.1.454.CMB.2.raw
  modified_base (321)..(321): a, c, t, g, unknown or other
  misc_feature (321)..(321): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggagcgtggtccagccgtgggagtcacagagactctcgtgtgcagcctcgtgggttcacctcagtaactacggcatgcacgtgggtccaccaagcctcgaggcgaagggtnttgggaggtggggtgcgtagtttgttcatcgtaggagggctaggttgttacaagtggtaatcggacgagacgtccggtagaacgggccgtaattccaactactccgtaccaaggaacactaacttaccgaaggaaaccagtaaagttagttaagtttagggacgtacttaaggaactacggtaccttaaacggtcccgtagggaaaccggaccggtaacggggtacgttaaacgttaccgttaacggtaaacgggtaacggggaaaacggggggacgggggaaacccgtaaggggaccggggtaacgtttacccggtaaaggttacccgttaaccgtttaacgggtaacccggg

SEQ ID NO: 332297 - DNA, 633 bp, Homo sapiens
  misc_feature: GZ8MTXP01DPC48.8.34.D01.1.454.CMB.2.raw
  modified_base (383)..(383): a, c, t, g, unknown or other
  misc_feature (383)..(383): n is a, c, g, or t
  modified_base (588)..(588): a, c, t, g, unknown or other
  misc_feature (588)..(588): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctcgtgtgcagcctgtggttcacctcagtaactacggcatcgcacgtcgggtccccgccaagcctacccgagggacgaacgggggtatttgggaggtggggtgtctaggtttgtttcacgtcgtaggaggctaggttnttacgaagttgggtatgactagtacgtcggtagacgggcctattccacctatcctaccgagaacgacaacgttaccgaaggaaaccactaaggttagttagtttagggatacgttacggaacctacgtaccttaacggtccgtaggacggacgaacggggtacttaagtacgttacgtagggtaacggaaggggacggggaacgngggacggtaacgttaccgaacgttccgttaacgtttcggaaccgg

SEQ ID NO: 332298 - DNA, 713 bp, Homo sapiens
  misc_feature: GZ8MTXP01BZHUQ.8.34.D01.1.454.CMB.2.raw
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggttcaccttcagtaactacggcatgcacgtgggtccncaagctccaggcaagggnttggagtgggtgctagtttgttcagtcgtggagggtctaggttcgttacaaagttgggtaatggcagaccgtccggtagggaaacgggcccgtattccgaacctatcctaccaagaacgaactaaacgttacccgaaaggaaaccaactaaagttacgttaaggtttaggggaacgtacgttaacgaaaccgtaacgtacccgttaaacggtaccccgtagggtaaccgggaaccggtaaccggggtaccgttaaacgttaaccgttaacccggttagggttaaaccggggtaaacgggggaacggggggaaacccgacggggttaccggggtaacggttacccgtaaacggttacccgttaccggtttacggtaaccggttccgggtaacccggggg

SEQ ID NO: 332299 - DNA, 658 bp, Homo sapiens
  misc_feature: GZ8MTXP01AQQCR.8.34.D01.1.454.CMB.2.raw
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcgtggtccaggccgtggggagtcacagagactctcgtgtgcagcctcgtgggttcaccttcagtaactacggcatgcacgtgggtcccgccaagcctaccgagggacgaaggggtattgggaggtgggggtggcgtaggtttcgtttcagttccgtaggaggggtctaggttgttaacaagttggtaatgacagtaccgtccggtagggaacgggccgtattccgacatcctacgaagacgaactaacttaccgaagtaacaacgtaagtggttaagtttgggacgtacgtagaaacgacgtaccgtaaacgtccgtaggacggaccgacgggtaactacttacgtacgttaggtaaacgggaaggggacgggggaaccgacgggaacggggtaacgttaacccgtaacggttccgttaccgtttaacggcccggttaacggg

SEQ ID NO: 332300 - DNA, 673 bp, Homo sapiens
  misc_feature: GZ8MTXP01CVU62.8.34.D01.1.454.CMB.2.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanacgccaccctctcctgcagggccagtcagatgtggcnctacgtatcctgtaccaacagaacctggccaggctcccaggcccctnatctatggtnccatcccgaacgacggggcccacgtggaccactccccgagcccgtaggtttcaggttcgggactaggggtgggtaacgtggggaaaccagtaacctttccaacttcctacaacccattcactcgacgcccgtagggacgtccgtaggacggtagttggttcgacgttagtttattacgttacgttaccgtaactaacgttccggtaccgggtacggtccgggtccccggttccgggggtacccttaccggtttcccgggaccccggttacgggggaacccgtaaacgggtcggttaacgtaacgttaccgtaaaacggtcgttacgggttcggcgtcggaccaacctagtcttcgttccttaacgttcc

SEQ ID NO: 332301 - DNA, 686 bp, Homo sapiens
  misc_feature: GZ8MTXP01BMOT2.8.34.D01.1.454.CMB.2.raw
  modified_base (628)..(628): a, c, t, g, unknown or other
  misc_feature (628)..(628): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttctttaagaggtgtccagtgtcaagtgcaacgtggtggagtcgtgggggagcgtggtccagccgtggggaggtcacgagagactctcgtgtgcacgtcctcgtgggttccaccttcagtaactacggcatgcacgtgggtccgccaagcctccgaggcaagggattgggagtggggtggctaggtttgttcagtcgtcggagggtcaaggttcgttacaaaagttgggtaattcggacgtacggtaccgtccgggtagggaaacggggtcccgtaagttcccgaacctatccgtaccgaaagaacgaacctaaacttaccgaaacggaaacctaactaaagttagttaaggtttacgggagtaccgtacgaaacgtacgtacccgtaacgtccgtacggacgggtaaccgacgggtaccgtaatacgttacgtaggttaaccggaaagggggaacgggggaaccgngggacgggtaacgttacgaacggttacgtccgtttacgaaccggttcggtaaccgggg

SEQ ID NO: 332302 - DNA, 672 bp, Homo sapiens
  misc_feature: GZ8MTXP01BWWDD.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggaggcgtggtccagccgtgggaggtcacagagactctcgtgtgcagcctgtcgggttcaccttcagtaactacggcatgcacgtgggtccgaccaagctccgaggcgaagggattgggaggtgggtgctagttgttcatcgtggagggctaggtgttcaaaagtggtaatgctagaccgtccggtaggaacgggcccgtagttaccacctatcctaccgaagaacgtaactaacttaccgaaggaaaccaacgtaaagttagttaacggtttgggaacgtccgtaagtaaaccgtacgtacccgtaaagtaccgtaggaacggaacgtaccggggtagtaacgtaacgttacggtacggttaacgggaaagggggaacggggggaaaccgttcgggaccggggtaacggttaccgtaacggttaccgttaccgtttacgggtaaccggttcggttaaccggggg

SEQ ID NO: 332303 - DNA, 550 bp, Homo sapiens
  misc_feature: GZ8MTXP01BOZ8R.8.34.D01.1.454.CMB.2.raw
  modified_base (298)..(298): a, c, t, g, unknown or other
  misc_feature (298)..(298): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctgggaggtcacagagactctcgtgtgcagcctctgggttcacctcagtaactacggcatgcactgggtcccncaagctccaggcaagggattgggagtgggtgctagttgtttcatctggaggcagtgttcaagtggtatgcagactcgtgaggcgatcacatctacagagacaattacagaacacaagtgtatttggagctagaacagacctaagtcctagacggacgaacgggcgttactaacgttacgtacggtaacggaagggacgggggaaccgaagggcgggaacgttaccgacggttacttccgtttgtaacccggg

SEQ ID NO: 332304 - DNA, 659 bp, Homo sapiens
  misc_feature: GZ8MTXP01DR7SP.8.34.D01.1.454.CMB.2.raw
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (408)..(408): a, c, t, g, unknown or other
  misc_feature (408)..(408): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagacgccaccctctcctgcagggccagtcagaatgttggcgcctagtatcctaggtaccaacagaaacctggaccaggcctcccacggcccctnatctatggngcataccaacgacgggccacgtggccaactccccgagccgtaggttcaggttcggctaggtggggtatcggggaaacaggtcttcactctcaacctntcatcagtcctggacgtcctaggacgtatgtgacttagtttactacgtgtacaacgtacgtccggtaaccggtaggtcccgggtccccggttacccgggggtacccttaaccgggttttcccgggacccggttacggggtaaacccaaaagggttcgggaaatttaccgttaaacgaaaaccggttaagttcgggttcggttacctcggacctaacccgtattccgttcgtttaacccgttcgttaacccg

SEQ ID NO: 332305 - DNA, 665 bp, Homo sapiens
  misc_feature: GZ8MTXP01CV1SL.8.34.D01.1.454.CMB.2.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagacgccaccctctcctgcagggccagtcagatgtgcnctagatcngacaacagaacngcagcnccagccctanantagngnacanacaacgcgcagtgacacnccagcgagtcagtcgagagtggtagnggaacagtctacactctaccaactatacgatacgacgccgtaggacgccgtaggtaggtagttagttacgtacgttaacgtttaacgtttaacgttacgttaacgtaaacgtaacgttaaccggttaaccgggtaaccggtaccgggtacccgggttacccggggtaccccggttacccggttacccgggtacccgggttaaccgggtaaaccggtaaacggtaacggttaaacgtaaacgttaaaccgtaaaaccggtaaacgttacggttcggttacgtaacgtaccgtaaccgtacgttacgttacgttccgttccgttaacg

SEQ ID NO: 332306 - DNA, 661 bp, Homo sapiens
  misc_feature: GZ8MTXP01ENAGJ.8.34.D01.1.454.CMB.2.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (640)..(640): a, c, t, g, unknown or other
  misc_feature (640)..(640): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccacctgtcttcgtctccgaaggggaaagacgccaccctctcctgcagggccagtcagaatgttggcgctagtatcctggacaacacgaaacctggccaggctcccgacggcccctnatctatggtnacactaccgaaacgacgggcccacgtggaccactccccagccaggttcaggtcggcgtaggtgggtagtggggaaacctaggtaacttcaactcctacaaccctatacaactcgacgtccgtgggacgtccgtaggtaggtagtttggttcgtacgttaagtttacttacgttacgtaactaaacgtacgttaccgggtaaccgtaggtcccgggtcccggttccgggggtacccttccggtttcccggggacccgtacggggtaacccgtaaagggtcggttacgtaacgttaacgaaacggtacttacgggttcgacgtgacctaacgtntcgttctccgttcgtaacccg

SEQ ID NO: 332307 - DNA, 680 bp, Homo sapiens
  misc_feature: GZ8MTXP01ATY5Q.8.34.D01.1.454.CMB.2.raw
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggaggtcacagagactctcgtgtgcagcctcgtgggtcacctcagtaactacggcatgcacgtgggtcccacaagcctaccgaggcgaaaggggtnttgggaggtgggggngtctaggtttcgtttacagttcgtaggacggggctaggttcgtttacaagttgggtaatcggacgtaaggtaccgtccgggtagggaacgggccgtaacttccgaaccgtatacccgtaccgaaggaacgtaactaaacgttacccgaaagggtaaaccaacgtaaggttacggttaagtttagggaacgtacgtaacgaaacgtaacgtaccgttaaacgtcccgtaggaccggtaacgaacgggtacgttaacgtacgttacgtaggtaacgggaaggggacgggggaaccgaaggacgggtaacgtaccgtaagttaccgttcgttcggtaaccgg

SEQ ID NO: 332308 - DNA, 630 bp, Homo sapiens
  misc_feature: GZ8MTXP01B1DJL.8.34.D01.1.454.CMB.2.raw
  modified_base (172)..(172): a, c, t, g, unknown or other
  misc_feature (172)..(172): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaacgtggtggagtcgtgggggagcgtggtccagcctgggagtcacagagactctcgtgtgcagcctcgtggtcactcagtaactacggcatgcacgtcggtccgccaagcctccgaggcaaaggggtgttagggagtgggggtgctaggtttgtttcatcgtggagggctagttgttacaagttgggtaatggactaggaccgtccggtaggaacgggccgtaatcacctatacctacccagacgaactaacttaccgaacggaaacactaagtagttaacgtttacggaccttacggaactacgtacctaagtcccgtagacgggtaacgcgggttaagtacgttacgtacgttaggtaacggaacggggacgggggaacagggaacgggtacgttaaccgtaacgtaccttccgttaacggttaacggttcccgggg

SEQ ID NO: 332309 - DNA, 731 bp, Homo sapiens
  misc_feature: GZ8MTXP01C2CZC.8.34.D01.1.454.CMB.2.raw
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgngcagcctcgtggttcaccttnagtaactacggcatgcacgtggggtcccncaagcctaccgaggcgaaaggggtgtttgggaggttcgggggtggcctaggttttcgtttcagttcgtggaggggtctaagttcgttacaaaagttgggtaacttggacccgtaaaggtacccgttccgggtaggaaacgggggtccctaatttacccaacctaactctacccgaaagaacgaaacctaaacttacccgaaggtaaacaacgtaaagttaggttaacggttttagggaacgtacgttaacgaaaccgtaaccgtacccgttaaacggtcccgttaggaacgggtaaccgacgggggtactaactaacgttacgttaggaaaccggaaagggggacgggggaaacccgaggggttaccgggtaagtttaacccgaaggttacccgttacgttttacgggaaccgtttcgggtcccggggg

SEQ ID NO: 332310 - DNA, 685 bp, Homo sapiens
  misc_feature: GZ8MTXP01DV2LG.8.34.D01.1.454.CMB.2.raw
  modified_base (610)..(610): a, c, t, g, unknown or other
  misc_feature (610)..(610): n is a, c, g, or t
tcagctcgcgtgtccacgaccggtgctcgatttagatcgtctgtgttgggtctgggagaggagcccagcactagaagtcggcggtgttcccattcggtgatcagcactgaacacagaggactcaccatggagtttgggctgaactgggttttcctcgttgcttcttttaagaggtgtccagtgtcaagtgcaactggtggagtcgtgggggaggcgtggtccagcctgggagtcacagagactctcgtgtgcagcctcgtgggttcaccttcaagtaactacggcatgcacgtcgggccacaagcctacgaggcaaaggggttgggagtgggtgctagtttgttcagtcgtaggagggtctaggttcgttacaaaagttggtaatgacgagtaccgtccgggtagggaaacgggccgtattcaaccatcctaccgaagaacgtaactaaacgttaccgaaaggaaacaactaaagttagttaaggtttagggaacgtacgtaacgaaacacgtacccgttaaaggtacccgtaggtaacggacgtaccgggtacgtaaattaacgttacggtaggttaaacgggaaacgggggaacggggggaaacccgnggggaaccgggtaacgtttacccgaaacggttaccgttaccgtttacggtaaccggttaacgggtaacccggggg

SEQ ID NO: 332311 - DNA, 569 bp, Homo sapiens
  misc_feature: GZ8MTXP01DKI87.8.34.D01.1.454.CMB.2.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (381)..(381): a, c, t, g, unknown or other
  misc_feature (381)..(381): n is a, c, g, or t
  modified_base (396)..(396): a, c, t, g, unknown or other
  misc_feature (396)..(396): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggcctcccagtttcagataccaccggagagattgtgttgacacaatctccagccaccctgtcttcgtctccaggggaaanagccaccctctcctgcagggccagtcagaatgttgcncctagtatcctggtacaacagaaacctggccaggctcccaggcccctnatctatggtncatccaacagggccactggaccaatcccagccaggttcagtcgcaggtgggtatgggaacagcttcactctcacctntcatcagcctggganccgtgaggtattgtgctagtttatactgtacaactattccgtacgagtcggcccgtcgggggaccctacgtttccggacccgtagggaaccccgtaaagttcgggaataacggttaccaaaacggtaaccgttgttcggttactgacaaccatccttgttcctttcgtaaccg

SEQ ID NO: 332312 - DNA, 592 bp, Homo sapiens
  misc_feature: GZ8MTXP01B2YBY.8.34.D01.1.454.CMB.2.raw
  modified_base (258)..(258): a, c, t, g, unknown or other
  misc_feature (258)..(258): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctntggtcactcagtactacggcatgcactgggtccaccaagctccgaggcaagggatttgggagtgggggtgctaggttgttcattcgtggagggctagttgttacaagttgggtatgacagacgtccggtaggaacgggccgagttcacctatctacccgagacgacaacttaccgaacggaaacaactaagttagttatttagggagtacgtagaaccacgtacctaaagtccgtaggacggaccgaacgggacgttatacttacgtaggtaacggaagggacgggggaaccaagggacggaacgttacgacgttacgttccgttggtaaccgg

SEQ ID NO: 332313 - DNA, 568 bp, Homo sapiens
  misc_feature: GZ8MTXP01AO0NN.8.34.D01.1.454.CMB.2.raw
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgcccaccctctcctgcagggccagtcagaatgtgcnctacgtatcctggtaccaacagaaacctggccaggcctcccgacggcccctnatctatggtncatccaaacgcgggccacgtggcactccccgagcccaggttcaggtcggcaggtcgggtatgggaacagcttcactctcacatcatcagcctaggacgcctgacggtattgttgacttagtttacttacgtcgtacaactagtccggtaccgaggtcggcccgtccgggggcctacgttccgggcccgttacgggaaccaaaggtcggaatacgttacgaaacgtacttggttcgactgcaactatcgttctcttctcg

SEQ ID NO: 332314 - DNA, 556 bp, Homo sapiens
  misc_feature: GZ8MTXP01BCVZ1.8.34.D01.1.454.CMB.2.raw
  modified_base (300)..(300): a, c, t, g, unknown or other
  misc_feature (300)..(300): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagtctggggagtcacagagactctcgtgtgcagcctctgggttcacctcagtaactacggcatgcacgtgggtcccnccaagcctccgagggcaaaggggtnttgggaggttggggtggctaggtttgtttcagttcgtggaggggcagttgttacaagtggtatgcagctcgagacggcatcacatcacagacacactcagaacacaagtgtattgagtctagacagacctagtcgtaggacggacgaacgggtcttagtacttacgtaggtaacggaaggggacgggggaaccgaagggacggtaagtacgacgttctccgttgtaaccgg

SEQ ID NO: 332315 - DNA, 668 bp, Homo sapiens
  misc_feature: GZ8MTXP01B089U.8.34.D01.1.454.CMB.2.raw
  modified_base (323)..(323): a, c, t, g, unknown or other
  misc_feature (323)..(323): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcgtggtccagccgtgggagtcacagagactctcgtgtgcagcctcgtgggtcacttcagtaactacggcatgcacgtcgggtccgccaagcctaccgaggcgaagggnttgggaggttggggtggctaggtttgtttcagtcgtggagggtctaggttcgttacgaaagttgggtaagtcggacgacgtaccgtccgggtagggaaacggggccctattccacctatccgtaaccaaggactaactaacttaccgaaagaacaactaagttgttaacggtttggaacgtactaacggaaactacgtacccgtaaagtcccgtaggaaccgggacgtaccggggtataacgtacgttacggtacggttaaacgggaaacggggacgggggaaccgcggttacgggggtaacttaccgaacgttacgtccgtttaggccggttcggtaaccgggg

SEQ ID NO: 332316 - DNA, 714 bp, Homo sapiens
  misc_feature: GZ8MTXP01EL9OQ.8.34.D01.1.454.CMB.2.raw
  modified_base (316)..(316): a, c, t, g, unknown or other
  misc_feature (316)..(316): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctggggaggtcacgagagactctcgtgtgcagcctcgtgggttccaccttcaagtaacctacggcatgccacgtcgggtcccnccaagcctaccgaggacgaagggggtatttgggaggtggggtggctaggtttgtttacagttcgtggaggggtctaggttcgttacaagttgggtaatggactagtaccgtcggtagaacgggcctacgttcaacctattacctacccgagaacgtaacctaaacgttacccgaaaggtaacccaacgtaaacggtttaggttaagttttagggaacgtacgtaacgaaaccgtacgtaacccgttaacggtacccgtaggaacgggaccgtaacgggggtacttaacgtaaaccgttaacgttacgggtaaacggggaaagggggaccgggggaaaccgtaacgggacgggtaacgttaccgtaacggttaccgttccggttttaacggtaaccggg

SEQ ID NO: 332317 - DNA, 642 bp, Homo sapiens
  misc_feature: GZ8MTXP01COZEG.8.34.D01.1.454.CMB.2.raw
  modified_base (210)..(210): a, c, t, g, unknown or other
  misc_feature (210)..(210): n is a, c, g, or t
  modified_base (298)..(298): a, c, t, g, unknown or other
  misc_feature (298)..(298): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaanagccaccctctcctgcagggccagtcagaatgtggcgcctacgtatcctggtaccaacagaaacctggccaggctcccacggcccctnatctatggtgcactcccaacgacgggggcccaacgtggccaactccccgaaggcccctaagggtttccaggttcggcgtaggttggggtatcgggggaaactaggtcctttcaaccttctacaccctatcatcagccgtggacgcctaggaggtattgttgacttagtttattacgtgtactaactagttccgtaccgtacggtcggcccggttccgggggtaccctaccggtttccgggaccccgttaggggaaaccctaaagggtcgggaattaacgaccgtaaaaccgtacgttacggttcgggactcggaccaactactcgttcgttccttccgtaaccg

SEQ ID NO: 332318 - DNA, 559 bp, Homo sapiens
  misc_feature: GZ8MTXP01CSUUQ.8.34.D01.1.454.CMB.2.raw
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (407)..(407): a, c, t, g, unknown or other
  misc_feature (407)..(407): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcanagagactctcgtgtgcagcctcgtgggttcacctcagtaactacggcatgcactgggtccncaagctccgaggcaagggnttgggagtgggtgctagttgtttcatcgtggaggggtcagttgttacaagtgggtatgcagactcggagacggcgattcacatctacaganacattccagaacacagtgtagtttgagtctagaacagacctaagtcctagacggacaacggggacttataaccgttacgtaggtaacggttaacgggagggggaaccaagggcgggtaacgttaccgaagttaccttccgttcggtaaccgg

SEQ ID NO: 332319 - DNA, 706 bp, Homo sapiens
  misc_feature: GZ8MTXP01D5B93.8.34.D01.1.454.CMB.2.raw
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctggggagtcacagagactctcgtgtgcagcctctgggttcacctcagtaactacggcatgcactgggtcccnccaagcctccaggacaaggggtnttgggagtggggtgctagttgtttcagtcgtgaggggtcaggtgttacaagttgggtaatcggcaaggtacctccggtaggaaacgggcccgtaattccaccacttctacccaaggtacgaacaaacttacccgaaagggaaacctaacgtaaagttcggtttaagttttagggacgtacgttaacggaaaccgtaacggtacccgttaaacggtcccgttaagggaacggggaaccggtaaaccgggggtttaggttaaacgttaaccgttaacggttacgggtaaaccgggaaacggggggttacggggggttaaaacccgaaggggtacggggtaacggtttacccgaaacggttaccgtttcccgttttaagggtaacccggg

SEQ ID NO: 332320 - DNA, 557 bp, Homo sapiens
  misc_feature: GZ8MTXP01DKEPM.8.34.D01.1.454.CMB.2.raw
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtatcctggtaccaacagaaacctggccaggctcccaggcccctnatctatggtgcatccaacgacgggccacgtggccactccccagcctaggttcagtcggcaggtggtangggaacagcttcactctacacatcatcagcctggacgcgtggagtattgtcgactagtttattactgtacaactagtcgtaccgtagtcggcccggtcccgggggcctccgttccggcccgtgggaacccaaggtggactagttaccgaaacgtcgttggttcggctgccaacgactcttgttccttctaaccg

SEQ ID NO: 332321 - DNA, 561 bp, Homo sapiens
  misc_feature: GZ8MTXP01CEJB5.8.34.D01.1.454.CMB.2.raw
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgttggcgcctacgtatcctggtaccaacagaaacctggccaggctcccaggcccctnatctatggtncatccaacgagggccatggcatcccagccaggttcagtcgcagtgggtatgggaacagcttcactctcaccatcatcagctggagcctgaggatgtgcttagtttattacgtgtactaactacgtcgtaccgtagtcggcccgtccgggggtcctaccgtttccggcccgtcgggaacctaaaggtggaatacgttacgaaaacgtacgttggttcgggctggactaacgtactcttacgttcttcgtaacc

SEQ ID NO: 332322 - DNA, 641 bp, Homo sapiens
  misc_feature: GZ8MTXP01CRY0M.8.34.D01.1.454.CMB.2.raw
  modified_base (273)..(273): a, c, t, g, unknown or other
  misc_feature (273)..(273): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagcctcgtgggttcacctnagtaactacggcatgcacgtcggtcccgccaagcctccgaggacgaaagggggtatttgggaggtgggggtggcgtagtttgtttcagttcgtaggagggtctaggttgttacaagtgggtatggacagactcggagaacgggccattcacatctacgagtagaactaacttaccgaaggaaacaacgtaaaggttgttaagtttagggaacgtacgtacgaaactacgtaaccctaaagtcccgtaggaacggaacggtaacgggtacttaagtaaccttacggtaagggtaaccgggaaagggggacgggggaaccgaagggaccgggtaagttaccgaagttaccgttccgttaaggtaaccggg

SEQ ID NO: 332323 - DNA, 651 bp, Homo sapiens
  misc_feature: GZ8MTXP01A4XL4.8.34.D01.1.454.CMB.2.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgccaccctctcctgcaggccagtcagatgtggcnctagtatcctagtaccaacagaaacctggaccaggcctcccacggccccctnactctagtggtcncactcccaaacgacgggcccacgtcggcctacgtccccagtcccaggtttcaggtcggcagggtcgggtatcggggaaacaggtccttcgacttcctaccaaccatcactacgacgtcccgtagggaccgtccgttaggaacgggtattggttcgtaccgttaagttttacttaacgttcgtactaaacgtacgtttaccggtaaccggtacggtccggtacccggttcccgggggacccttacggtttcccggccgtacgggaacctaaagggtgactacgttaaccgaaacgtcgttggcgacctggaccaaccttagtcgttacgtccttcgtaaccc

SEQ ID NO: 332324 - DNA, 620 bp, Homo sapiens
  misc_feature: GZ8MTXP01DMW27.8.34.D01.1.454.CMB.2.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (416)..(416): a, c, t, g, unknown or other
  misc_feature (416)..(416): n is a, c, g, or t
  modified_base (597)..(597): a, c, t, g, unknown or other
  misc_feature (597)..(597): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaaggggaaanacgccaccctctcctgcagggccagtcagaatgtggcnctagtatccngtaccaacagaaacctggccaggcctcccacggcccctcatctatggtgcactccaaacgacgggcccacgtggcactcccagcccgtaggttcaggtcggctaggtgggtatggggaacagtcttcactcctacaccatcactcacgcctgggacnccgtaggacgtattgttagacgttagtttaacttactagtactaaacgtacgttaccgttacggaggttccggcccggtccgggggtacccttacgtttcccgggaccgttacgggaacctaaaggtcggaattaacgttaacgaaaacgtacttcgggttcggacctggacctaaccgtntacggttcttccttcgtaacccg

SEQ ID NO: 332325 - DNA, 679 bp, Homo sapiens
  misc_feature: GZ8MTXP01C7XXO.8.34.D01.1.454.CMB.2.raw
  modified_base (298)..(298): a, c, t, g, unknown or other
  misc_feature (298)..(298): n is a, c, g, or t
  modified_base (624)..(624): a, c, t, g, unknown or other
  misc_feature (624)..(624): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtgggttcaccttcagtaactacggcatgcacgtcggtccnccaaagcctaccgaggcgaagggtatgggagtgggggtgctaggtttgtttcagtcgtggagggtctagttgttacaaaagttgggtaatggaccgtaacgaccgtaccgggtaggaaacggggtcccgtaactttaccacctaacttccgtaccgaaggtaacaaccgtaaacgttacccgaaaggaaacaaacgtaaattaggttaaggttttagggacgtacgtacgaaactacgtactaacggttaccgtaggtaacggacgtacggggtacttaacgtaacgttacggtaggttaacgggaaaggggaacgggggaaccgngggacgggtaacgtacgtaacgttacgtcgtttaggtaaccgttcggtaaccggg

SEQ ID NO: 332326 - DNA, 639 bp, Homo sapiens
  misc_feature: GZ8MTXP01EV5M7.8.34.D01.1.454.CMB.2.raw
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
  modified_base (383)..(383): a, c, t, g, unknown or other
  misc_feature (383)..(383): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgtgcagcctcgtggttcacctcagtaactcggcatgcacgtgggtcccncaagctccgaggcgaagggtnttgggaggttggggtggctaggtttgtttcagtcgtggagggtctagtgttacaagtggtancgcagtaccgtcggtaggacggcgattcgacatccgtacagacgacaacttaccaaggaacactaagttacgttaagtttgggacgtacgtacgaaacgtacgtaacccgttaaacggtcccgtaggacggtaaccggaaccggggtacgttaacgtaaccgttacgtacgggtaacgggaaagggggttacgggggaaacccgtgggacggggtaacgttaccgaacggttccgttccgtttaaggtaacccggg

SEQ ID NO: 332327 - DNA, 589 bp, Homo sapiens
  misc_feature: GZ8MTXP01BFJAP.8.34.D01.1.454.CMB.2.raw
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctgtgggttcaccttcagtaactacggcatgcacgtgggtccgccaagcctccgaggcaaggggnttgggaggtgggggtggctaggtttgttcagttcgtgggagggtctaggttgttacaaagttggtaatgcagctcggtagaacgggccgtattccaccatcctccgagacgaactaattccgaaggaacacaattcgtagtttgggatctagaactagacctaagtccctaggaacggacacgggctaagtacgttacgtaggttacggaaggggacgggggaacgcggcgggtaacgtcgtaacgtacgtcttggtccgttcggtcgggg

SEQ ID NO: 332328 - DNA, 642 bp, Homo sapiens
  misc_feature: GZ8MTXP01AKSII.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagacgccaccctctcctgcagggccagtcagaatgtggcgcctacgtatcctggtaccaacagaaacctggccaggcctcccacggcccctcatctatggtgcatccaacgacggggcccacgtggcactccccagccaggttcaggtcggcaggtgggtatggggaacagtcttcactctcacatcatcagcctggacgccgtggacggattggttgcgttagtttacttacgttgtaccaactagtccggtaaccggtacggtcgggcccggtcccgggggtaccctaccggttttcccggggccccgttacgggggaacccgtaaaggtcgggttaaacgtaacgttaaccgaaaaccggtaacgttcgggttcggttaccgttcggaccgtaaccctacgttccgttcgttaaccgtttcgttaaccccg

SEQ ID NO: 332329 - DNA, 737 bp, Homo sapiens
  misc_feature: GZ8MTXP01CYTFI.8.34.D01.1.454.CMB.2.raw
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaggggaaagacgccaccctctcctgcagggccagtcagaatgttggcgtcctagtatcctagtaaccaacagaaacctggccaggcctcccgacggcccctnactctagtggtnacactaccgaacgacgggcccaacgtggacctacgtcccgagcccgtaaggttccaaggtccggacgtagggttggggtacgtcggggaaaccaggtaacctttccaaccgttactacccaacctattccaactccgaacgtcccgtagggacgtccgtagggtaaggtatttggttacgtacttaagttttaactttacgttcggtaactaaacgttacgttaccgggtaaccggtagggttcccgggtcccgggttcccgggggtacccttaaccgggttttccccgggaccccgggttaacggggaaacccgtaaaagggttcgggttaaactttacgaaaccggtaaaaaccgtcgttacgggttcgttacgtaacggtaccctaaccttagtccgttcgttccctttcgttaacccg

SEQ ID NO: 332330 - DNA, 563 bp, Homo sapiens
  misc_feature: GZ8MTXP01BU56W.8.34.D01.1.454.CMB.2.raw
  modified_base (391)..(391): a, c, t, g, unknown or other
  misc_feature (391)..(391): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggcccaggcctccccaggccccctcatcctatggtgccatcccaaacgacggggcccactggcatccccagcccaggttcaggtcggcaggtgggtatggggaacagcttcactcncaccatcatcacgcctgggacgccgtgaggatgttgctagtttattactgtacaactagtccgtaccgagtcggcccgtccgggggcctaccgttccggcccgtcggggaccaaaggtcggatacgacgaaacgtaacttcggttggcgtgcaaccatcttcgttcttcgtc

SEQ ID NO: 332331 - DNA, 732 bp, Homo sapiens
  misc_feature: GZ8MTXP01BEZC0.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagcctggggaggtcacagagactctcgtgtgcagcctcgtgggttcacctcagtaactacggcatgccacgtcgggtcccgccaagcctaccgagggacgaaagggggtcgtttgggaggttgggggtggtcgtaggtttgtttccagttcgtggaggggtctaggttgttacgtaagttggggtaacttggacgtaacggtacccgttccgggttaagggaaccgggggtaccctaacgttcccaaccgtacttacccgtacccgaagtaacgaactaaacgttaccgaaaggtaaacctaaccgtaaaggtttacggtttaagtttaagggacgtacgttaacggaaaccgtacggtaacccttaaacggttccgtagggaacggtacggtaacgggtacgttacgtaaccgttacgtacgggtaaacgggaacgggggttacgggggaacccgaagggaccgggtaacgttaccgaacgttaccgttccgtttaaggtaacccggg

SEQ ID NO: 332332 - DNA, 837 bp, Homo sapiens
  misc_feature: GZ8MTXP01CF99Y.8.34.D01.1.454.CMB.2.raw
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctggggaggtcacagagactctcgtgtgcagcctcgtgggttcacctcagtaactcggcatgccacgtgggcccnccaagcctacgaggcaaggggnttgggagtggggtgctagtttgtttcatcgtggaggggctaggttgttacaagtgggtaatggacaaggtacctccgggtaggaacggggtcccgtaagtttccgaaccctacttccgtacccgaaaggtaacggaacctaaacgtttaccccgaaaacgggtaaacctaaaccgtaaacggtttaggtttaaacgtttttagggggaacgtaccggttaacggaaaacccgtaaacggttaaccccgttaaaacgggttaccccgttaaggggtaaaccgggggaaacccgggtaaaccggggggttaacccggtttaaacggtttaaaccccggttaaacgggtttaaaccgggggttaaaacccgggggttaaaacggggggggaaaccggggggggggttaaaaacccggaacggggggtaacccggggggttaaaccgggtttaaccccgggtaaaaccgggttttaacccgtttaaccccgggtttttaacggggttaaaccccggggg

SEQ ID NO: 332333 - DNA, 735 bp, Homo sapiens
  misc_feature: GZ8MTXP01CKT8X.8.34.D01.1.454.CMB.2.raw
  modified_base (206)..(206): a, c, t, g, unknown or other
  misc_feature (206)..(206): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgggtttggggaggaactgctcagtcaggacccagagggaaccatggaagccccagctcagcttctcttcctcctgctactctggctccagtttcagataccacggagagattgtgttgacacaatctccagccacctgtcttcgtctccgaggggaaancgccaccctctcctgcgacgggccagtcaagtaatggttggccgccttacgtactccgtaggtaaccaacgaacgtaaaccgtcggaccacggcctcccgacggtccccctanactctagtggtcgacctactacccgaaacggacggggacccctacgtcgggacctaacgtccccgacgtacccgtaggtttccgaacgggttcgggacgtaggggtagggggttaacgtacgggggaactaacggtacctttaccgaaaccttcctaccaaccgtactaccactaccgacggtccgtacgggaacgtccgtagggtaggtacgttggttacgtacgttaaacggttttacttaacgttacgggtaacctaaacgtaccgttaccggtaaccggtacggtccgggtcccgggttaccgggggccttaccggttcccggtacccgtaggggaaaccctaaggttcggtaacttacgtaaacgaacgttacgttgttcggtctacgaacacgtcttacgtcgttcgttc

SEQ ID NO: 332334 - DNA, 673 bp, Homo sapiens
  misc_feature: GZ8MTXP01CCICH.8.34.D01.1.454.CMB.2.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtggggaggtcacgagagactctcgtgtgcagcctcgtggttcacctcagtaactacggcatgcacgtgggccncaagctccgaggcgaagggntgggagtggggtgctagtttgttcatcgtggagggtctagtgttacaagtggtatgcgaggactccggtaggaacggggtcctaacgttccaacctattcccgtaccgagaaacgtactaaacgttacccgaaaggaaacctaaacgtaaaggttaggttaagtttagggaacgtacgtaacgtaaaccgacgtaacccgttaaacgttccgtaggaacggtaccggaaccggggtacttaacgtaaccgttacggtaaggtaacggggaaacgggggttacgggggaaaccgtaagggggtacgggtaacgttaccgtaacggttaccggttccgtttcgggtaacccggg

SEQ ID NO: 332335 - DNA, 545 bp, Homo sapiens
  misc_feature: GZ8MTXP01D2S21.8.34.D01.1.454.CMB.2.raw
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
  modified_base (528)..(528): a, c, t, g, unknown or other
  misc_feature (528)..(528): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtatcctggtaccaacagaaacctggccaggcctcccaggcccctnatctatggtncactccaaacgacgggccactggcactcccagccaggttcagtcggcaggtgggtatgggaacagtcttcaactctacaccatcatcagcctggcnccgtgaaggtnttgtnacttagttactatcgtacaactcgtacgtacgngtccggccggtccgggacctcgttccggccgtaggaactaagtgatacacgaaacgtcgttgttcgctgcctaactntcttcgttccttctaac

SEQ ID NO: 332336 - DNA, 688 bp, Homo sapiens
  misc_feature: GZ8MTXP01AOGR7.8.34.D01.1.454.CMB.2.raw
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
  modified_base (392)..(392): a, c, t, g, unknown or other
  misc_feature (392)..(392): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacgagagtactcgtcgtgtgcagtcctcgtggttcacctnaagtaactcggnatcgctacgtcgggtcccacaagcctaccgaggacgaaggggtnttggggaggttggggtgctaggtttcgtttcagttcgtaggagggtctaggttcgttanaagttgggtaactgacgtagtaccgtcggtaggaacgggtctacttaccgacctattccgaccgaagtacgtaacctaaacgttaccgaaaggtaaaccaagtaaggttacggttaagtttaggacgtacgtaacgaacgtacgtaaccgtaacggtcccgtaagggaaccggtaaccggtaacgggtaacttagtaacccgttaggttaacgggaaaccgggaagggggacggggaacgaagggtaccgggtaacgttaccgtaacggttaccgttcgttaacgggtaacccggg

SEQ ID NO: 332337 - DNA, 750 bp, Homo sapiens
  misc_feature: GZ8MTXP01D9QOV.8.34.D01.1.454.CMB.2.raw
  modified_base (329)..(329): a, c, t, g, unknown or other
  misc_feature (329)..(329): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtggggaggtcacagagactctgtgtgcagcctcgtggtcacctcagtaactcggcatgcacgtgggtcccgacaacgctcgaggacgaagggnttgggagtggggtgctagttgtttcagtcgtggaggtctagtgttacaagtgggtatcgacgtaacgtacgtcggtagggaacgggtccgtaacttaccaaccctacttcctaacccgaagtaacgaaccctaaacgttacccgaaaggtaaaaccaaccttaaaggggttcggtttaaaggtttacgggaagtaccgttaacgaaaccgtaacggtaccccgtttaaaaggtccccgttaagggaaccgggtaaccggtaaccggggtacttaaacgttaaaccgttaccggtaaagggtaaacccggggaaaggggggaacccggggggaaaccgtaacgggggaccggggttaaccgggttaaaccccggtaaacgggtttacccgttaacccggtttttaacgggtaaccccggggg

SEQ ID NO: 332338 - DNA, 589 bp, Homo sapiens
  misc_feature: GZ8MTXP01ALWGU.8.34.D01.1.454.CMB.2.raw
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccaggcctggggaggtcacagagactctcgtgtgcagccctctgggttcaccttcagtaactcggcatgcacgtgggtcccnccaagctccaggcaagggnttgggagtgggngcagttgtttcatcgtggagggcagtgttcaagtggtatgcagactcgtagacggcgattcactatctaccagagacaacttaccaaggaacacaagtgtagtttggacgtctagaacacgtacctaacgtccgtagaacggacgaacgggacttagtacttacgtacggtaacggaacggggttacgggggaaccgaagggtacgggtaacgttaccgtaacggttaccgttccgtttggtaaccggg

SEQ ID NO: 332339 - DNA, 695 bp, Homo sapiens
  misc_feature: GZ8MTXP01CI4VN.8.34.D01.1.454.CMB.2.raw
  modified_base (340)..(340): a, c, t, g, unknown or other
  misc_feature (340)..(340): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgtgcagcctcgtggttcaccttcagtaactcggcatcgcacgtcgggtcccaccaagcctaccgaggaccgaaaggggtntttagggaggttggggtgctaggttttcgtttcccagttcgtgggaggtctaaagggttgttcaaagttgggtatcggacagtaccgtcggtaggaacgggcctagttccaccgtatcctaccgagacgaactaacttaccgaagtaaccaacgtaagttaggtttagtttacgggacgtaccgtaggaaaccgtacggtacccgtaaacggtcccgtagggaacgggtaaccggtaacggggttacgttaaacgttacgttaaaccgtagggttaaaccggggaacgggggacggggggtaaaccgaggggtaacgggtacgttaccggaacgttaaccgttccgtttaacggg

SEQ ID NO: 332340 - DNA, 687 bp, Homo sapiens
  misc_feature: GZ8MTXP01B36Q1.8.34.D01.1.454.CMB.2.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagatgtggcnctagtatctgtaccaacagaaacctggaccaggcctcccaggccccctnatctagtggtgcaactcccaaagacgggccacgtggaccactccccgagcctaggttcaggtcggacgaggtgggtatgggaaacaggtcttcactctacaacctatcaatcacgtcccgtagggacgtccgtaggaaagggtattcgggtttagaccgttaagttttaacttaacgtcggttaacctaaacgttacgttccggtaaccggtacgggttcccgggtaccccgggttcccggggggtacccttaccggttttcccggggacccgttacgggggtaaccctaaagggtcgggttaattaacgttaaccgaaaaacggtccgttgggttcggttaccgttcggaccctaacctacgttccttcggtttccttaaccgttaacccg

SEQ ID NO: 332341 - DNA, 672 bp, Homo sapiens
  misc_feature: GZ8MTXP01DUQOW.8.34.D01.1.454.CMB.2.raw
  modified_base (308)..(308): a, c, t, g, unknown or other
  misc_feature (308)..(308): n is a, c, g, or t
  modified_base (617)..(617): a, c, t, g, unknown or other
  misc_feature (617)..(617): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactcgtcgtgtgcagccctcgtgggttccaccttcaagtaacctacggcatcgcacgtcggtcccnccaagcctccgaggcaagggattggaggtgggtgctagtttgttcagtcgtaggagggtctaggttgttacgaaaagttgggtaatcgaccgtaaggtacccgttccgggtagggaaacggggtccctaagtttacccaaccgtactccgtaccgaagtaaacgtaacctaaacgttacccgaaaggtaaaccaaacgtaaagttagttaaggtttaggacgtactaacgaaacacgtacctaagtaccgtagacggtacgaccgggctaataacttacgtaggttaacggaaaggggacggggaacgngggacgggtaacgttaccgaacgtccgttccgttgtaaccgttcggtaaccgggg

SEQ ID NO: 332342 - DNA, 691 bp, Homo sapiens
  misc_feature: GZ8MTXP01A6ZHM.8.34.D01.1.454.CMB.2.raw
  modified_base (297)..(297): a, c, t, g, unknown or other
  misc_feature (297)..(297): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgtggcgctacgtatctggtaccaacagaaacctggccaggcctcccgaggccccctnactctatcggtgcactccaaacgcggggcccaacgtggaccacgttcccccgagcccgtaggttcaggtcgggcgtagggtggggtatcgggaacaggtcttcacttcctacaccatcatccagccgtagggacgccgtggacggtagttgttaggtacttagtttaatacttacggtactaaacgtagttccgggtacgtacggtccgggtcccgggttacccgggggtcccttaaccggttttcccggggaccccggttacgggggtaaacccgtaaagggttcggggttaaacttacggttaaaccgtaaaaccgggtaacgttcgggttgggttacccgttcgacccggtaacccttagttccgttacgtttccccgtttcttaaccccg

SEQ ID NO: 332343 - DNA, 675 bp, Homo sapiens
  misc_feature: GZ8MTXP01EB0BY.8.34.D01.1.454.CMB.2.raw
  modified_base (297)..(297): a, c, t, g, unknown or other
  misc_feature (297)..(297): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagacgccaccctctcctgcgaggccagtcagaatgtgcgcctacgtatcctggtaccaacagaaacctggccagcctcccgacggcccctnactctagtggtgccatacccaacgacgggcccacgtggacccaacgtcccccaggccctagggttccaaggttcggcgtaggttggggtatggggaaacagtcctttcacttcctccaacctatcatccagtcccgtgggacgcctaggaggtattgttgacttaacgtttatttaacgttcgtactaacgttacgttaccggtaccggtacggtccgggtccccggtcccgggggtaccccttaccggtttcccggggaccccgttacggggaaaccctaaaagggttcgggttaaattaacggttaaccgaaaacgtacgttacgggttcgttacgtcggaccaacctagttccgttacgttccttaacgttcccg

SEQ ID NO: 332344 - DNA, 777 bp, Homo sapiens
  misc_feature: GZ8MTXP01BSIOJ.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccacctgtcttcgtctccgaggggaaagacgccaccctctcctgcagggccagtcagaatgttggcgcctacgtatcctggtaccaacacgaaacctggaccacggcctaccccgacggccccctcgacttcctagtcggtcgactactaccccgaacgacggggacccacgtggaccacgtccccagcctacggttccaggtcggacgagggtaggggtacgtcggggaaactaggtccttcacctctaccgaccactacactaccgacgtccgttacgggacgtcccgtaggtaacgggtagtttcgggttacggactttaaacggttttaacttaccgttacggttaacctaaaccgttacggtttaccccgggtaaacccggtacgggttcccggggtccccgggttaccccggggggtacccttaacccgggttttccccggggaccccggttaaccgggggaaacccgtaaaaggggtcgggttaaacttaaaccggttaccgaaaaaccgggttacgttacgggttcgggaccttaacgggaccctaacccgtacgtttccgttacgtttccgtttaacccgtaacccg

SEQ ID NO: 332345 - DNA, 564 bp, Homo sapiens
  misc_feature: GZ8MTXP01DU4NE.8.34.D01.1.454.CMB.2.raw
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (468)..(468): a, c, t, g, unknown or other
  misc_feature (468)..(468): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagttttcagataccaccggagagattgtgttgacacaatctccagccaccctgtcttcgtctccaggggaaagacgccaccctctcctgcagggccagtcagaatgttggcgcctagtatcctaggtaccaacagaaacctggccaggctccccaggccccctanactctagtggnacactacccaaacgagggaccctacgtcggaccaactccccgagccctaggttcaggtcggactaggttgggtancggggaaacagtcttcactctacacatcatcancgngcgctgagtntgtgatagttattactgtactaactatacgtacgngtcggccggtccgggcctcgttcggccgtacggacgaaagtgatacaacgaaacgtacttagttcggcgtcactaaccattcttcgttcgttcgtc

SEQ ID NO: 332346 - DNA, 712 bp, Homo sapiens
  misc_feature: GZ8MTXP01A68WG.8.34.D01.1.454.CMB.2.raw
  modified_base (345)..(345): a, c, t, g, unknown or other
  misc_feature (345)..(345): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccaggccgtggggagtcacgagagactcgtcgtgtcgcagcctcgtgggttccacctcaagtaactacggcatcgcacgtcgggtcccacaagcctaccgagggacaagggggtntttgggaggttgggggtgctaggtttgttcagttcgtaggaggtctaggttcgttacaagttgggtatcgacaacggtacgtccgggtaggaacggggtcctaattccgactactccgtaccgaagtacaactaacttaccgaaaggtaaacctaacgtaagttcggttaagtttaggaacgtactaacgaactacggtaaccgtaacggtcccgtaagggaaccggaaccggtaacgggtacgttaaacgtaccggttaacgtaggggtaaaccggggaaagggggaccgggggaaaccgtaaggggaccggggttaacgttacccggtaacggttaccgttccggttttaacgggtaacccgggg

SEQ ID NO: 332347 - DNA, 829 bp, Homo sapiens
  misc_feature: GZ8MTXP01A9P1D.8.34.D01.1.454.CMB.2.raw
  modified_base (271)..(271): a, c, t, g, unknown or other
  misc_feature (271)..(271): n is a, c, g, or t
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagcctgtgggtcacctnagtaactacggcatgcacgtgggtcccacaagctccgaggcaagggtntgggagtggggngctagttgtttcattcgtaggaggggtcaggttcgttacgaagttgggtaatcgggacgtaacgggtaacccgttcccggggtaagggaaaccgggggtacccgtaacgtttacccgaacccttaacttacccgttaaccccgaaaggtaaaccggaaacccttaaacgtttaccccgaaacggggtaaaacctaaccgttaaaaggttttacggggtttaaaggttttacgggaaacggttaccgttaaccgaaaaccgtaccggttaaacccgttaaaccggtttaccccggtaagggaaaccgggtaacccgggtaaaccgggggtaccgttaaacgttaaaccggttaaccggttaaagggggtaaacccggggaaaaggggggttaaccgggggggaaaaccccgtaacggggggtaccgggggtaaaccggtttaccccgggaaaacggtttacccggtttaacccggtttttaaccgggggtaaccccggg

SEQ ID NO: 332348 - DNA, 671 bp, Homo sapiens
  misc_feature: GZ8MTXP01AU9HV.8.34.D01.1.454.CMB.2.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctctgggttcaccttcagtaactacggcatgcacgtgggtccnccaagctccgaggcaaggggattgggaggtggggtggctagtttgttcatcgtggagggctaggtgtacaaagtggtaatgcagactcggtagaacgggccgattcaccgatctaccgagacgacaacgttacccaaggaaccaactaagttagttaaggtttaggggacgtcgtacgtaaaccgaacgtacccgtaaacggttacccgtagggtaacgggaaccgtacggggtacgtaactaacgttaaccgtagggttaaacgggtaaacgggggaacggggggaacccgacggggttaccggggtaacgttacccggaaacgttaacccgttccggtttacggtaacccgggttcgggtaacccggggg

SEQ ID NO: 332349 - DNA, 639 bp, Homo sapiens
  misc_feature: GZ8MTXP01DMQTU.8.34.D01.1.454.CMB.2.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggtcaccttnagtaactacggcatgcacgtcgggtccnccaaagcctaccgaggcaaagggggatttgggagtggggtggctaggtttgtttcagtcgtggaggggctaaggtgttacaaaagttgggtaatgacaggactccggtagggaaacgggcccgtattcaccatctaccgaagaacgacaattaccaagaacaactaaatgtagtttaggagtaccgtagaaacacgaccgtaagtacccgtaggtaacggacgacgggcgttaactacgttaacgtaggttaacgggaaaggggaacgggggaaaccgagggaccggggtaagttaccgtaacggttacctaccgtttacgaaccggttcggtaaccggggg

SEQ ID NO: 332350 - DNA, 609 bp, Homo sapiens
  misc_feature: GZ8MTXP01AXM95.8.34.D01.1.454.CMB.2.raw
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctctggtcactcagtaactacggcatgcacgtgggtcccgccaagcctccgaggcaagggtnttgggagtgggtgctagttgttcatctggaggcaggtnttacaagtgggtatgactagaccgtcgtagacgggccgtattccacctatctaccagacgaacaattacccgaaggaactaacgtaagttagttaagtttaggagtcctagaactacgtacctaacgtcctaggacgacgaacggggtacttacgtacgttacgtaggtaaccgggaaggggacgggggaaacccaaggggcgggtaacgttaccgaaggttacccgttccgttaagggtaacccgg

SEQ ID NO: 332351 - DNA, 847 bp, Homo sapiens
  misc_feature: GZ8MTXP01DO34P.8.34.D01.1.454.CMB.2.raw
tcagctcgcgtgtccacgaccggtgctcgatttagatcgtctgtgttgggtttgggctgaactgggttttcctcgttgctcttttaagaggtgtccagtgtcaagtgcaactggtggagtctggggggaggcgtggtccagcctgggaggtcacagagactctcgtgtgcagcctctgggttcaccttcagtaactacggcatgcacgtgggtccgccaagctccgaggacgaagggattgggaggtggggtggctagtttgttcatcgtggaggctagtgtactaagtggtatgacaagtactcccggtaggaacgggccgtaattccgaacctactcctaccgaagaacgtaactaactttacccgaaaggaaacctaacgtaaagttagttaacgtttagggaacgacgtaacgaaaaccgtaacggtaaacccgttaaacgttcccgtaagggtaaacgggaaaccggtaaccgggggtacgttaaacgttaaacgttaaaccggtaacgggttaaaccgggaaacgggggaaacggggggaaaccgtaacgggaacgggggttaaccgttaaccggtaaacggttacccgttacccggttacggtaaccggtccggtaccgggggtacccggttaacggggtacccgttaccgggtacccgtaccccggttacctccccgttaccgaacccgtacccgtaccccgaacccgtaaccgggtccccgtaacggttccccgttaccccgtttcccccgttccggccccgtccccgttaccgcccgttaccccggaacggtccgaaccccgtacccgtacccggacgaacccgccgtaaccccggg

SEQ ID NO: 332352 - DNA, 640 bp, Homo sapiens
  misc_feature: GZ8MTXP01A7KEH.8.34.D01.1.454.CMB.2.raw
  modified_base (268)..(268): a, c, t, g, unknown or other
  misc_feature (268)..(268): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttctttaagaggtgtccagtgtcaagtgcaactggtggagtcgtgggggagcgtggtccagccgtgggagtcacagagactctcgtgtgcagcctcgtggtcactnagtactcggcatgccacgtcggtccgccaagcctccgaaggcaaggggtnttgggagtggggtgctagttgtttcagtcgtggacgggtctaggttgttacaagtggtaatgacgtagaccgtcggtagacggcctagttcacctatcctacgagacaactaacttaccgaaaggaactacgtaaggttcgttaagtttggaacgtacgtacgaaacgtacggtaacccgtaacgtcccgtaggaacggaaccggtaacggggtacttaacgtacgttaacgtacgggtaaacgggaaagggggttccggggaaacccgaaggggtaccggtaacgttacccggaagttacccgttcgttaaggtaacccgg

SEQ ID NO: 332353 - DNA, 671 bp, Homo sapiens
  misc_feature: GZ8MTXP01DOKNQ.8.34.D01.1.454.CMB.2.raw
  modified_base (299)..(299): a, c, t, g, unknown or other
  misc_feature (299)..(299): n is a, c, g, or t
  modified_base (612)..(612): a, c, t, g, unknown or other
  misc_feature (612)..(612): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctcgtggttcaccttcagtaactacggcatgcacgtcgggtccnccaaagcctccgaggcaagggattgggagtggggtgctagtttgttcatcgtggagggctaggttgttacaaaagttggtaattgacctaacggtaccgttccgggtagggaaacggggtcccgtacgtttccaacctactcctacccgaagtaacgtaacctaaacttacccgaaggaaacctaactaaagttagttaaggtttaggagtaccttacgaaacgtacgtaccgttaacggtacctaggacggacgtacgggacgttaacgtacgttacgtaggttaacgggaaaggggtaacgggggaaccgngggacgggtaacgttaccgaacgttaccgtccgttacggtaaccggttcggtaacgggg

SEQ ID NO: 332354 - DNA, 715 bp, Homo sapiens
  misc_feature: GZ8MTXP01DXTPC.8.34.D01.1.454.CMB.2.raw
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaagtggtggagtcgtgggggaggcgtggtccagccgtgggagtcacagagactctcgtgtgcagcctcgtggttcaccttcagtaactcggnatgcacgtgggccncaagcctacgaggcaagggtnttgggagttggggtgctagtttcgtttccagttcgtaggagggtctaaggttcgtttaacgaaagttgggtaatcggacgaacggtaccgttccgggtaggaacgggtaccgaactttacccgaaccttaacgtcccgtaaccgaacgtaacgtaaacctaaacgttaccgaaaggtaaacccgaaacgtaaacgtttacggtttaagtttacgggaacgttaccttacggaaactaaccgggtaccttaaacggtcccgtaggacgggtaaaccgacgggttacgtaacgttaacgtaacgttaacgggttaacgggaaacggggttaacgggggaaccgagggtaacgggtacgtaccgttaacgttaaccgttcgtttaaccggg

SEQ ID NO: 332355 - DNA, 818 bp, Homo sapiens
  misc_feature: GZ8MTXP01AHMUR.8.34.D01.1.454.CMB.2.raw
  modified_base (302)..(302): a, c, t, g, unknown or other
  misc_feature (302)..(302): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagccgtgggagtcacagagactctcgtgtgcagcctcgtgggttccaccttcagtaactacggcatgcacgtgggtcccnccaagcctaccgagggcgaagggggattggggaggtggggtggtctaggtttgtttcattcgtggaggggtctaggttgttacaaagttcgggttaatggaccgtaggtaccgttcccggggtagggaaacggggtcccgtattccgaaccctaatcccgtaccgaacggaacgaaacctaaacgttaccgaaacggtaaacctaaaccgtaaagttaggtttaacgggttttaggggaacgtaccgttaacggtaaaaccgaacggtaaccccgtaaaggttaccccggttaagggtaaccggggtaaccgtaaccgggggtaccgtttaaacggtaaaccgtttaaaccgggtttaacggggttaaacccgggggtaaaggggggtaaaccggggggggttaaacccggttaacgggggacccgggggttaacgggtttaacccggtaaaccgggtttaacccggtttacccggttttacgggtaacccgggtttccgggttaacccggggggg

SEQ ID NO: 332356 - DNA, 697 bp, Homo sapiens
  misc_feature: GZ8MTXP01BVBE4.8.34.D01.1.454.CMB.2.raw
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagatgtggcgctacgtatcctgtaccaacagaaacctggccaggcctcccgacggcccctnactctagtggtncactccaacgagggccacgtggccactcccagccaggttcaggtcggctaggtgggtanggggaacacgtaacttcacgtctacacctatcatcacgccgtagggacgtcctaggacggtattggttacgtacttaagtttaacgttacgttacggtacaaacgtagttacccggtaaccgggtacggttcccggggtccccgggttccccggggggtacccctttaacccggggttttccccgggaccccgggttaacgggggtaaacccgtaaaaggggttcggttaaacgttaaacgttaaaccggtaaaacccggtaacgttcggttcgggaccttcggaacctaaccgttacttccgttcgttcccgtttaaccgttccccg

SEQ ID NO: 332357 - DNA, 739 bp, Homo sapiens
  misc_feature: GZ8MTXP01EJ2PD.8.34.D01.1.454.CMB.2.raw
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttctttttaaagaggtgtccagtgtcaagtgcaacgtggtggagtcgtgggggagcgtggtccagcctgggagtcacagagactctcgtgtgcacgtcctcgtcgggttcaccttcaagtaactcggcatgcacgtcgggtccnccaagcctccgaggacgaaggggtnttgggaggttggggtcgctagtttgttcagttcgtggagggtctaggttgttacgaaaagttgggtaatcgtaccgtaaggtaccgttccgggtaggggaaacgggtacccgtacgttaccacctactacctaccgaagaacggtaacctaaacttacccgaaaggtaaacccagtaaagttacggtttaaggtttacgggtaacgtaccgttaacggaaaaccgtaccggtaacccgttaaacggtacccgttagggtaaccgggtaaccgtaacggggtaccgtaacgttaacgttaacggtacggttaaacggggaacgggggaaacgggggaccgacgggttacgggtaacggtaccgtaacggttacccgttccgttacggtaaccggttcggtaaccggggg

SEQ ID NO: 332358 - DNA, 800 bp, Homo sapiens
  misc_feature: GZ8MTXP01A0N0C.8.34.D01.1.454.CMB.2.raw
  modified_base (334)..(334): a, c, t, g, unknown or other
  misc_feature (334)..(334): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagcctcgtggttcaccttcagtaacctacggcatgccacgtcgggtcccaccaagcctccgaggcgaaggggnttgggaggtggggtggctaggtttgtttcccagttcgtagggacgggtctaaaggttcgttaacgaaagtttcgggtaatcgggtacaacggtaacccgttcccggggttaagggaaacgggggtaccccgtaacgtttacccgaacccgttaacttaccccgttacccggaaacggtaaaccggtaaaccctaaaaccgtttaccccgaaaaggggtaaaccctaaacggtaaacgtttaggtttaagtttacggggaacgtacccgtaaagtaaaccgacggtaaccccttaaagggttcccgtagggaacgggtaaccggaaccgggggttacttaacgttaaccgtaaaccggtaacgggttaacggggttaaacgggggaaccggggggaaaccgacgggggtaaccggggtacggtttaacccggttaaacggtttaacccgtttccggtttaaccgggg

SEQ ID NO: 332359 - DNA, 734 bp, Homo sapiens
  misc_feature: GZ8MTXP01BXDM2.8.34.D01.1.454.CMB.2.raw
  modified_base (274)..(274): a, c, t, g, unknown or other
  misc_feature (274)..(274): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagtactctcgtgtgcagcctcgtcggttcaccttnagtaactacggcatgcacgtcggtccgaccaagcctacgaggcgaaagggtnttgggagtgggtgctaggtttnttcagtccgtggaggtctaagttgttaacaaagtgggtatgacgtaacgtaccgtccgggtaaggaacggggtaccctattaccaccgtattaccctacgtaagtaacggaacttaaaccttaccggaaacggaaacaaacgttaagttaggggtttagtttacggggaatacgttaagaaaccgtacgtaaccttaaacggtcccgtaagggaacggtaacccgtacggggtaacccgtttaattaaccccgttaaaggttacgggaaaacggggtaacgggggaaaccggggggttaaaccacggggtaaccggggttaacgtttaaccccggaaacgttacccggtttaccgtttaacgggttaaacccgggtttcccggggg

SEQ ID NO: 332360 - DNA, 728 bp, Homo sapiens
  misc_feature: GZ8MTXP01D8ARN.8.34.D01.1.454.CMB.2.raw
  modified_base (273)..(273): a, c, t, g, unknown or other
  misc_feature (273)..(273): n is a, c, g, or t
  modified_base (365)..(365): a, c, t, g, unknown or other
  misc_feature (365)..(365): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggaggtcacagagactctcgtgtgcagcctcgtgggttcacctnagtaactacggcatgcacgtggcccgccaagctccgaggcaagggattgggagtgggtgctagttgttcatctggagggctaagttcgttanaagttggtaactggcaagtaccgtccgggtaggaacgggtccgtacttcaacctatccgttaacccgaagaacgaacaaacttacccgaaaggtaaaccaacgtaaagttagtttaagtttagggaagtaccgttaggaaacctacgtaaacccgttaaacggttcccggttaggaacgggaaaccggtaaccgggggtaccttaaacggttaaaccgtttaaaccggttaaaggggttaaaccgggggaaaaggggggaaccggggggggttaaaacccgaagggggtaaccgggggtaacggttttaaccccgaaacgggtttaacccgtttaacccggtttttaacggggtaaccccggg

SEQ ID NO: 332361 - DNA, 646 bp, Homo sapiens
  misc_feature: GZ8MTXP01D3G7A.8.34.D01.1.454.CMB.2.raw
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctcgtgtgcagcctcgtgggttcaccttcagtaactacggcatcgcacgtgggtccnccaagcctccgaggcaaggggtntttgggaggtgggggtgctaggtttgtttcagtcgtggagggctaggtcgttacaagttgggtaatggcaggtacgttccgggtaggaacgggtccgtattccaacctatccgtaccgaagaacgaaccaaacttacccgaaggaaactaacgtaaagttagttaagtttaggagtacgtacgaaacacgtacctaagtacccgtaggaacgggaacgaacgggtacgttataacgttaacgtaggggtaacggaaagggggacgggggaaaccgaagggcgggtaacgttaccgaagttacgttaaccgttggtaaccgg

SEQ ID NO: 332362 - DNA, 777 bp, Homo sapiens
  misc_feature: GZ8MTXP01CE9JO.8.34.D01.1.454.CMB.2.raw
  modified_base (322)..(322): a, c, t, g, unknown or other
  misc_feature (322)..(322): n is a, c, g, or t
  modified_base (735)..(735): a, c, t, g, unknown or other
  misc_feature (735)..(735): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtcctccgaggggaaagacgccaccctctcctgcagggccagtcagaatgttggcgcctacgtatcctaggtaccaacagaaaccgtcggaccacggcctcccgacggcccctacactctagtggtcncgactaccgaaacgacggggacctacgtcggcccactccccgacgcccgtaggttccgaggtccggccgtaggggtcggggttaagtacgggggaaactaacggttccttacctaaccttccctaccaaccctacttaccaaactccgaacgtccccggttaggggaccgtccgttaagggacgggttacgtttaggttcggtacgttaacggtttttaacttaccgttacggtaacctaaacgttacggtttacccggtaaccggggtacggttccccggggtaccccggggttcccgggggtaccctttacccggttttcccggggacccggtttaacgggggaacccgtaaaagggttcggttaaacgttaacttaaacgggaaaacccggttagttcgggttcggaccnggttacccaacgttatccttacggttcctttaacgtaacccg

SEQ ID NO: 332363 - DNA, 712 bp, Homo sapiens
  misc_feature: GZ8MTXP01ARZ4L.8.34.D01.1.454.CMB.2.raw
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagccgtggggagtcacagagactgtcgtgtgcagcctcgtggttcaccttcagtaactaggcatgcacgtgggcccaccaaggcctaccgagggcgaaagggggttttcgggagtggggtagcgtagtttgtttacagttccgtggagggtctaaggttcgttaacaaaggttggtatgaccaacggtccttccgggtagggaaaccggggccccgtaatttacccaaccctacgttaccctacccgaaggaaccgtaaacctaaaccgttacccgaaagggaaaccaacctaaagtttcgggtttaaggtttacgggaagtaccgttaacggaaaccgacgtacccgttaaagtcccgtaggaacgggaccgacgggggtaacctaagttaccgtacgttacggtaaacgggaacgggggacgggggaacccttagggcgggtaacgtaacccgtaaggttacccgttacgtttcggaacggttccggg

SEQ ID NO: 332364 - DNA, 634 bp, Homo sapiens
  misc_feature: GZ8MTXP01BC85K.8.34.D01.1.454.CMB.2.raw
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (611)..(611): a, c, t, g, unknown or other
  misc_feature (611)..(611): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgagggaaanagccaccctctcctgcagggccagtcagaatgttggcgcctagtntcctgtacaacagaaacctggccaggctcccaggcccctnactctagtggtncatccaacgacggggcccaacgtcggacactccccgagcccgtaggttcaggttcggctagggtggggtagtggggaacaggcttcactctccacatcatcagtccgtggacgcctgggacggtattggtcgacgttagtttaacgttactcgtaacgtaactacgttcgtaccggtaggtcccggccggtacccgggggtacccttacgtttcccgggacccgttcggggaaacccgtaaaagggttcggttaaacgtagttaaccgaaaacgtacgttcgttacggcttaacggcctaaccgnttacttcgttccttaactaaccg

SEQ ID NO: 332365 - DNA, 680 bp, Homo sapiens
  misc_feature: GZ8MTXP01CAHUI.8.34.D01.1.454.CMB.2.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (330)..(330): a, c, t, g, unknown or other
  misc_feature (330)..(330): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctcgtgtgcagcctcgtgggttcaccttnagtaactcggcatgcacgtgggtcccnccaaagtcctaccgaggaccgtaaaggggtnttgggaggttggggtggcgtagtttggttcagttcccgtgggaggtctaaggtcgttaacaaagttgggtaatcgacgtagtacccgttaccgggtagggaacgggcccgtattaccacctactcctacgaagaacgaacctaacttaccgaaggaaactaactaaagttaggggttaagtttagggactacgtagaaccacgtacctaaacgtccgtaggaacggaccgaacggggtctaagttacgtaaccggttaggtaaccgggaaggggaaccggggggaaccagggaaccgggtacggttaaccgaacggttaccgttaccgtttaacggaacggttcccgggg

SEQ ID NO: 332366 - DNA, 777 bp, Homo sapiens
  misc_feature: GZ8MTXP01BG9PI.8.34.D01.1.454.CMB.2.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgtgcnctagtntcctgtaccaacagaactggccaggctcccgaggcccctnatctagtggtgcactccgaacgacgggcccaacgtggccactccccagccgtaggttcaggtcggacgtagggtggggtagtggggaaacacgtcttcacctcctacacctatcgactcacgccgtagggacgtcccgttagggacggtacgtttggttacgaccgtttaaggttttaactttacccgttaggttaacctaaacgttaccggtttacccgggttaaacccggtacgggggttccccgggtaccccggggttccccggggggtaacccctttaaccggggttttcccccgggggacccggttaaaccggggggtaaacccctaaaacggggtttagggttaaaccgtttaaaccgttaaaccggaaaaaaacccgggttaacggttccgggggttacggttaacccggttccgggaaaccctaacccgttaacggttccctttcggtttaacccccgttttaaccgttaacccccg

SEQ ID NO: 332367 - DNA, 666 bp, Homo sapiens
  misc_feature: GZ8MTXP01BVRZV.8.34.D01.1.454.CMB.2.raw
  modified_base (209)..(209): a, c, t, g, unknown or other
  misc_feature (209)..(209): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccacctgtcttcgtctccgaggggaaancgccaccctctcctgcgacgggccagtcagtatgttggctcctacgtatccgtaggtaccaacgacgaaaccgtggcccacggcctaccccgacggtccccctnactctagtggtcgactactaccaacggacgggtacccacgtggaccacgtccccgaggccctagggttccgaggttcggacgtagggtggggtagtacggggaactacgtccttcaccttctaccactatcactcgacgtccgtggacgtccgtaggacggtgttggttcgtacgttagtttactacgttctaccgtaacgtcgttaccggtaacgtggtcccggtcccgggtccgggtacccttacggttcccgggcccgtacgggaaccgtaaaggtcggttactacgaaccgtaaacgtcgttggttcggctaacggcctaacgtctcgtttacgtccgttcgtaacccg

SEQ ID NO: 332368 - DNA, 574 bp, Homo sapiens
  misc_feature: GZ8MTXP01C8HSK.8.34.D01.1.454.CMB.2.raw
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (281)..(282): a, c, t, g, unknown or other
  misc_feature (281)..(282): n is a, c, g, or t
  modified_base (284)..(286): a, c, t, g, unknown or other
  misc_feature (284)..(286): n is a, c, g, or t
  modified_base (290)..(290): a, c, t, g, unknown or other
  misc_feature (290)..(290): n is a, c, g, or t
  modified_base (293)..(294): a, c, t, g, unknown or other
  misc_feature (293)..(294): n is a, c, g, or t
  modified_base (298)..(298): a, c, t, g, unknown or other
  misc_feature (298)..(298): n is a, c, g, or t
  modified_base (301)..(302): a, c, t, g, unknown or other
  misc_feature (301)..(302): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaaggggaagacgcccaccctctcctgcaggccagtcagatgtgcgctatatctgacanagaacngcngcnccagccnatnngnnncagngcnngcanccnncagtcagtcgcaggtgtagnggaacagtctcactcncaccntcactcacgtcctaggacgccgtaggagtgttggttcacgttagtttattacgtcggttaactaacgtacgttaccggtaaccggacggtcccgggtcccgggtcccgggggtacccttaccggttcccgggtacccggtacgggtaaaccgaaaggtggttaactaacgttacgaaacgtcgttaggttcggactcgacctaacgtctcgttacgttccttcttaacccg

SEQ ID NO: 332369 - DNA, 555 bp, Homo sapiens
  misc_feature: GZ8MTXP01EL36X.8.34.D01.1.454.CMB.2.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (457)..(458): a, c, t, g, unknown or other
  misc_feature (457)..(458): n is a, c, g, or t
  modified_base (460)..(463): a, c, t, g, unknown or other
  misc_feature (460)..(463): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
  modified_base (520)..(520): a, c, t, g, unknown or other
  misc_feature (520)..(520): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcncccaggcccctcatctagtcggtagccaactaccgaaccacggggtcccacgtgggcccaagtcccccaaggtcccaggttcgacggtgggcgtaagtgggggtaactagggggaacctcggaccttcactctcaccatcatccagcgtggagccgtgaggtatgctagtnntnnnntntctactacgtcgtactacncgtactacgtcgtcgtcgtcgttcgtcgcgtcgtcncgcgcgcgcgtcgtcgtcgttaccgtcgttcgtcg

SEQ ID NO: 332370 - DNA, 778 bp, Homo sapiens
  misc_feature: GZ8MTXP01C1DNO.8.34.D01.1.454.CMB.2.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacctgtcttcgtctccgaaggggaanacgccaccctctcctgcgaggccagtcagatgtggcgctacgtatcctgaaccacagaaacctggaccaggcctccacggcccctnactctagtggtcgacacgtacccaaacgacggggacccacgtcgggaccaacgtcccccgaaggccccgtagggtttccaagggttcgggaccgtagggttgggggtaactagggggtaaaccagggtaacctttcccaaccttccttaccaacctattacaacttaccgacgtcccgtagggaacgtccgttagggaaggtagttcggtttacggtactttaggtttaactttaccgttaggttacctaaacgtagttacccggttaaccgggacggttccggggtccccggttcccggggggtaccccttaaccgggttttccccggggaccccggttaacgggggtaaccccgaaaaggggtttacgggttaactttaaacggaaccgttaaaaaccgggaccgttaacggggttcggttaccgttaacggacccgtaacccttaacgtttccgttacggtttccctttccgttaaccccg

SEQ ID NO: 332371 - DNA, 685 bp, Homo sapiens
  misc_feature: GZ8MTXP01A0771.8.34.D01.1.454.CMB.2.raw
  modified_base (155)..(155): a, c, t, g, unknown or other
  misc_feature (155)..(155): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttccncgttgctcttttaagaggtgtccagtgtcaagtgcaactggtggagtcgtgggggagcgtggtccagcctggggagtcacagagactctcgtgtgcagcctcgtgggttcaccttcagtaactacggcatgccacgtcgggtcccacaagctccgaggcaaggggnttgggagtgggggtggctaggtttgtttacagtcgtcggaggggtctaggttgttacaaagttgggtaatcggacaggacctcggtaggacgggcccgattcaacctactcgtaccgagaacgtaacaacttacccgaaggtaaacacgtaagttgtacggtttaggaacggtctacgaaaccgcgtaaccgttaacggtacccgttaggtaccggaacgtacggggtacgttaacgtaaccgttaaccgtagggttaaaccgggaaacggggtacggggggaaccccgttagggaccggggtaacgttacccgtaaacggttacccgttccggttacgggtaaccgttaacgggtcccggggg

SEQ ID NO: 332372 - DNA, 713 bp, Homo sapiens
  misc_feature: GZ8MTXP01B02L9.8.34.D01.1.454.CMB.2.raw
  modified_base (301)..(301): a, c, t, g, unknown or other
  misc_feature (301)..(301): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggttcaccttcaagtaactacggcatgcacgtcggggtcccnccaaagcctccgaggcgaaagggtattgggaggtggggtgcgtagtttgtttcagtcgtggaggtctagttgttacaaaagttgggtaatgtaccagtaccgtccgggtaggaaacggggtccctagttaccacctatccgtaccgaagaacgtactaaacgttaccgaaaggaaaccaactaaagttgtaaggttttagggagtaccttacgaaaccgtagtacccgtaaacgttacccgtaggaacgggtaccgacggggtacttaaacgtaaccgttacggtaacggttaaaccgggaaagggggaacggggggaaaccccgaggggttaacccggggtaacggtttacccgtaaacggtttacccgttaccggtttacgggtaaccggttccgggttaacccgggggg

SEQ ID NO: 332373 - DNA, 678 bp, Homo sapiens
  misc_feature: GZ8MTXP01E0F1J.8.34.D01.1.454.CMB.2.raw
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
  modified_base (369)..(369): a, c, t, g, unknown or other
  misc_feature (369)..(369): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaaggggaaagacgccaccctctcctgcagggccagtcagaatgtgcgctagtatcctagaaccaacagaaacctggccaggcctcccgacgcccctnatctatggtncactccaacgnggcctacgtggcactcccgagcctaggttcaggtcggcgtaggtgggtagngggaacagtcttacgactctccaacctagtcatcgacgtccgtagggacgtccgtagggaaggtagtttggttcgaactttagtttaacttacgtacgtaacctaaacgtacggtttacccggtaaccggtgggttccccgggcccgggtttacccggggggtacccttaccccgggttttacccggggaccccggttaacggggaaaccccgtaaagggttcgggttaaactaacgttaaaccgaaaacggttacgttcggttcggactcggacctaacccgatttcgcgttaacctttcgtaacccg

SEQ ID NO: 332374 - DNA, 545 bp, Homo sapiens
  misc_feature: GZ8MTXP01CZF2Z.8.34.D01.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (359)..(359): a, c, t, g, unknown or other
  misc_feature (359)..(359): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacagagactctcgtgtgcagcctcgtgggttcacctcagtaactacggcatgcactgggtccnccaagcctccaggcaagggnttgggagtgggtgctagttgttcatctggaggcagtgttnaatggtatgcagactcgagaacggcgatcacatctcagagacaatccaagaacacaagtgtattggagctagaacagaccctagtccgtaggacggacgaacgggtcgttagtaacttacgtaggtacggaaaggggcgggggaaccaagggacgggaacgttacgaagttactcgttgtaaccgg

SEQ ID NO: 332375 - DNA, 647 bp, Homo sapiens
  misc_feature: GZ8MTXP01A8FEJ.8.34.D01.1.454.CMB.2.raw
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaatggtggagtcgtgggggaggcgtggtccagcctggggagtcacagagctctcgtgtgcagcctcgtgggttcaccttcagtaactacggcatgcacgtcgggccaccaagcctccgaggcaaggggtnttgggaggtgggtaggctaggtttnttacatcgtggaggggtctaggttgtacaaagttgggtaatggacagacgtccggtaggaacgggccctattccgacctatctaccgaaggagaacctaagttcccgaaaggaacaactaagttattaggggttgagtctagaacacgaccttaacgtcctaggacggtaaccacgggtacgtaacgttaacgttacgtaacgggttacggggaaacggggaacgggggttaaccggacgggacgggttaaccggtacgtaacgttacgttacccgttagtaacggttcggtaaccggggg

SEQ ID NO: 332376 - DNA, 560 bp, Homo sapiens
  misc_feature: GZ8MTXP01AQYHT.8.34.D01.1.454.CMB.2.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (405)..(405): a, c, t, g, unknown or other
  misc_feature (405)..(405): n is a, c, g, or t
tcagctcgcgtgtccacgaccggtgctcgatttagatcgtctgtgttgggtttgggagctctgggagaggagcccagcactagaagtcggcggtgtttccattcggtgatcggcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggttcactcagtaactcggcatgcactgggtcccnccaagctccaggcaagggtntgggagtgggtggctagttgttcagtctggagggtcagtgtacaagtggtatgcagactcggtgagggcatcacatctacanagacattcagacacagtgtagtgagctaggacagactaacgtccgtagacggacgtaacgggcgttataccgttacgtacggtaacggaacgggttacgggggaccgaagggcgggtaacgtaccgtaacgttaccgttccgtttggtaaccggg

SEQ ID NO: 332377 - DNA, 677 bp, Homo sapiens
  misc_feature: GZ8MTXP01ADTCV.8.34.D01.1.454.CMB.2.raw
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (632)..(632): a, c, t, g, unknown or other
  misc_feature (632)..(632): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccaggccgtggggaggtcacgagagactcgtcgtgtgcagccctgtggttcacctcagtaactcggcagtgcacgtggtcccncaagcctccgaggcaagggtnttgggagtgggggtgctaggtttgtttcagttcgtggacgggtctaggttgttacgaagtgggtaatcggacgacgtaccgtccgggtagggaacggggtccgtacgttaccaaccgtacgtccgtacccgaaggtaacgtaaccgtaaacgttacccgaaacggtaaacctaacgtaaaggttaggttaacggtttaggaacgtacgttacgaaaccgtacgtaccgtaacgtccgtaggacggacgaacgggtacttacgtacgttacgtacggtaacggacggggacggggaaccgngggacgggtaacgttaccgaacgttaccgtccgttggtaaccggg

SEQ ID NO: 332378 - DNA, 642 bp, Homo sapiens
  misc_feature: GZ8MTXP01ETB2U.8.34.D01.1.454.CMB.2.raw
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccacctgtcttcgtctccgaaggggaaagacgccaccctctcctgcagggccagtcagaatgtggcnctacgtatcctgaccaacagaacctggcaggcctcccaggcccctnatctatggnacactaccaacgaggccagtggaccatcccagccaggttcaggtcgcgaggtggatgggaacagtcttcgactctacacctatcatcagcctagggacnccgtggaacggtntttcggtacgacttaaggttttaacttacgtcgttaaccaaacttacggttaccggtaccggtaagggtcccggtccccgggtccgggggtacccttaaccggtttcccggggaaccgtacgggaaaccgtaaaggtcggttaaattaacgaaaccgtaaaacggtacgttcggttcgaccgtggaccctaaccgttattccggttacttaacctttcgtaaccccg

SEQ ID NO: 332379 - DNA, 683 bp, Homo sapiens
  misc_feature: GZ8MTXP01AYHQ1.8.34.D01.1.454.CMB.2.raw
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (445)..(445): a, c, t, g, unknown or other
  misc_feature (445)..(445): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagacgcccaccctctcctgcgagggccagtcagatgtgcnctagtatcctgaccaanagaactggccaggctcccgagcccctnatctagtggtgcactaccaacgacgggccctacgtggaccacgtcccgagtcctaggttcaggtcggcaggtggggtagtcggggaaacacggtaaccttcaaccgtcctaccaacctatacataccacgtccgtaggacgtcctggaacgtnttcgttgacgttagtttaacttacgttacgtacaaacgtacgttccggtaaccggtacgggtccgggtaccccgggttccgggggtccctaccggttttcccggggaccccgttaacgggggaacccgtaaaagggtcgggttaaactaaacgttaacccgtaaaacgggtaacgttcgggttcgggaccttaacggacccaaccgtacttccgttacgttccctttaacgtaacccg

SEQ ID NO: 332380 - DNA, 776 bp, Homo sapiens
  misc_feature: GZ8MTXP01ATUV6.8.34.D01.1.454.CMB.2.raw
  modified_base (320)..(320): a, c, t, g, unknown or other
  misc_feature (320)..(320): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagcccaccctctcctgcagggccagtcagaatgttggcgcctacgtatcctggtaaccaacacgaaacctggaccacggcctcccacggccccctgatcctagtcgggtnacctactaccccgaaacgacggggacccctaactttcggaccaaccttcccccgaaggtacccgtaagggtttccgaagggttccggggaccgtaggggttgggggtaagtcgggggaaacaacgggtaaccctttccaaccttctaccaccctaatctaacggtcaacggtcccttagggggaccgtccgttagggaaacggttagtttgggtttacgtaccgtttaagtttttaacttacccggttagttaaaccgtaaacgtacggttacccgggtaaccgggttacgggtcccggggtccccgggttcccggggggtaccccttaccggtttcccggggaccccggttaggggaaacccgtaaaaggtcgggttaacttaaccgaacgaaaacccgtgttgggttaccggcttcggacctaacccgttgttccgttacttccttcgtaaccg

SEQ ID NO: 332381 - DNA, 741 bp, Homo sapiens
  misc_feature: GZ8MTXP01CXCU7.8.34.D01.1.454.CMB.2.raw
tcagctcgcgtgtccacgaccggtgctcgatttagatcgtctgtgttgggtttgggctgaactgggttttcctcgttgctcttttaagaggtgtccagtgtcaagtgcaactggtggagtctgggggaggcgtggtacagcctgggaggtcacagagactctcgtgtgcagcctctgggttcaccttcagtaactacggcatgcactgggtccgccaagctccaggcaagggattggagtgggtgctagttgttcatctgaggcagtgtcaatggtatgcagactccgtgaaggccgattcacatctccagagacaattcagacacaatgtattcggagctagaacacgacctaaagtccgtagaacgggacgacggggtacgtaatacgtaacgtaggtaacggaaaggggacggggggaaaccgagggaccggggtaacgttaccgaaacgttaccgttacccgtttaggaaccggttcggtacgggggtaccggtaacgggggttaccccgttcggggtacccgtacccgggttccctaccccgtccgtaccggtccccgttaccccgaaccccggtaaccggggtccccctaacggttccccggggttccccgtttcccccccgggttcggggtccccccggtcccccgttccggttccccgttaccccggaaccggggtaacccgccccgtaaccccgttcccgggaaccggtaaccgggcccgtaaaccccgggg

SEQ ID NO: 332382 - DNA, 717 bp, Homo sapiens
  misc_feature: GZ8MTXP01CG06K.8.34.D01.1.454.CMB.2.raw
  modified_base (325)..(325): a, c, t, g, unknown or other
  misc_feature (325)..(325): n is a, c, g, or t
tcagctcgcgtgtccacgaccggtgctcgatttagatcgtctgtgttgcgtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgtgcagcctcgtggttcaccttcagtacacggcatgcacgtcgggtcccaccaagcctccgaggcgaaaggggtnttgggaggttgggtggctagtttgtttcagtccgtggagggctagttgttacaagttggtatggactagtaccgtccgggtagggacgggcccgtacttaccgacctactacctaccgaaggtacgaacctaacttaccgaaacgggaaaccaacgtaaacgttaggggtttaagtttacggggaacgtacgttaacgaaaccgtaccgtacccgttaaacgtccgtaagggaaccgggtaaccggtaaccgggggtaacgttaacgttacgttaaccggttaacgggttaaacgggaacgggggaacggggggaacccgaggggtaaccggggtacggttaaccgtaacgggttacccgttaccggtttcgggttaaccggttcccggggg

SEQ ID NO: 332383 - DNA, 764 bp, Homo sapiens
  misc_feature: GZ8MTXP01CUFJ8.8.34.D01.1.454.CMB.2.raw
  modified_base (339)..(339): a, c, t, g, unknown or other
  misc_feature (339)..(339): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtgggagtcacagagactctcggtgtgcacgtcctcgtggttcaccttcagtaactacggcatgcacgtcgggtccaccaagcctccgaaggcgaagggtnttgggaggtggggtgtcgtaggttttcgtttacccagttcgtagggacggggtctaaagggttgttaacaaagttcgggtaatcgaccgtaacggtaccgttaccgggtagggtaacggggtccgtaacgttccgacccgtaacgtaccttacccgaaagaacgtaaacctaaacgttacccgaaacgggtaaaccctaaacggtaagtttacggtttaagtttacgggacgtaccgtaacgtaaaccgtaacggtacccgttaacggtaccgtacggaacgggtaaccggtaacggggttacgttaaacgttaccgttaaacgtacggggttaaaccggggaaagggggaacggggggaaaccgacggggtaaccggggtaacgttaacccggaacggtttaaccgttaaccggtttaaccggg

SEQ ID NO: 332384 - DNA, 690 bp, Homo sapiens
  misc_feature: GZ8MTXP01AYIDZ.8.34.D01.1.454.CMB.2.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (642)..(642): a, c, t, g, unknown or other
  misc_feature (642)..(642): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggagtcacagagactctcgtgtgcagcctgtggtcacctnagtaactacggnatgcacgtgggtccncaagcctacgaggcgaagggtntgggaggtgggtgctagtttgttcagttcgtaggacggtcaggttcgttacaagttgggtaactgacgaaggtaccgtccgggtaaggaacgggtacccgtacttacccaaccgtacttacccgtaacccgaaggtaaacgtaacctaaacgttacccgaaacgggaaacctaaactaaacggttaggtttaagttttacgggaacgtacgtaacggtaacgaccgtaaccgtaacgtcccgtaggaaccgggacgaacggggtacttaacgtacgttacgtaacgggtaacgggaaggggaaccgggggttaacgnggggacgggtaacgtacgtaaacgttcgttccgtttgggtaacccggg

SEQ ID NO: 332385 - DNA, 589 bp, Homo sapiens
  misc_feature: GZ8MTXP01BMWQS.8.34.D01.1.454.CMB.2.raw
  modified_base (247)..(247): a, c, t, g, unknown or other
  misc_feature (247)..(247): n is a, c, g, or t
  modified_base (575)..(575): a, c, t, g, unknown or other
  misc_feature (575)..(575): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgttgcncctagtatcctggtaccaacagaaacctggccaggcctcccgaggccccctcatctatggtgcactccgaaacgaggggcccacgtggccactcccagccaggttcagtggcaggtgggtatggggaacagtcttcactcacaccatcatcagcctggacgcctgacggtattgtgtctagtttattacgtgtacaactagttcgtaccggtaggtccggccgttcccgggggcctaccggtttcccggcccgttacgggaacccgtaaaggtcggagtacgttacgaaacgtaacgttcggttcggctcggactaacctactcgttnttccgttcgtaacc

SEQ ID NO: 332386 - DNA, 621 bp, Homo sapiens
  misc_feature: GZ8MTXP01AYT49.8.34.D01.1.454.CMB.2.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagcctgtggtcactnagtaactcgcatgcagtcggtccnccaagctccgaggcgaagggtnttgggagtggggngctaggtttgtttcagttccgtaggagggtcaaggttcgttacaagttgggtaatcggacgtagtaccgtcgggtaggaacggggtcctattaccaacctatccgtaacccgaagaacgaacctaaacgttacccgaaaggaaaccaacgtaaaggttagttaagtttaggagtacgtagaaaccgagtacctaaagtccgtaggacggacgaacgggtacttagtacgacgtaggtaacggaaggggcggggaacaagggacggtaacgttacgaagttacctcgttcgcgg

SEQ ID NO: 332387 - DNA, 657 bp, Homo sapiens
  misc_feature: GZ8MTXP01C2WRE.8.34.D01.1.454.CMB.2.raw
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaanacgccaccctctcctgcagggccagtcagtaatgttggcgcctacgtatcctaggtaaccaacacgaaacctggaccaggcctcccacggcccctnactctagtggcacactaccaacgacgggccacgtcggactacnccccgaggcctaggttcaggtggacgtaggtgggtanggggaaacctataaccttcaacttcacaaccatcgaactcgacgtcgtaggacgcgtaggagtattgtagtattaagtttacttacgtagtaacgtaacgtacgtccggtacggtacggtccgggtacccggtccggggtacctaccggtttcccgggacccgtaacgggaaacgtaaaggttacggttaaacttaacgaaaccgtaaaaccggtacgttcggttcggacgtaacgacctaacgtacttcgttcgtttccttaaccgtaac

SEQ ID NO: 332388 - DNA, 730 bp, Homo sapiens
  misc_feature: GZ8MTXP01BO3LM.8.34.D01.1.454.CMB.2.raw
  modified_base (286)..(286): a, c, t, g, unknown or other
  misc_feature (286)..(286): n is a, c, g, or t
  modified_base (334)..(334): a, c, t, g, unknown or other
  misc_feature (334)..(334): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccaggccgtggggagtcaacagagactcgtcgtgtgcagcctcgtgggtcaccttnagtaactcggcatcgcacgtcggcccacaagctccgaggcgaagggtnttgggagtgggtggctaggtttgttcagtccgtaggcgggtctaggttgttacgaagttgggtactggacgtaaggtaccgttcgggtaaggaacggggtcccgtaacgttaccaaccgtactacccgtacccgaagaacgtaactaacgttaccccgaaaggtaaaccaactaaggttaggttaagtttaggaacgtacgtaacgaacgtacgtaacccgttaacgtaccgtacggaacgggtaaccgtaacggggtaccgttaaacgtaaccggttaacgtaacggggttaaacccggggaaaagggggaccggggggaaacccgaagggggtaccggggtaacgtttaacccgtaacgggtttacccgttaaccggtttcgggtaacccgggg

SEQ ID NO: 332389 - DNA, 698 bp, Homo sapiens
  misc_feature: GZ8MTXP01C4DSL.8.34.D01.1.454.CMB.2.raw
  modified_base (176)..(176): a, c, t, g, unknown or other
  misc_feature (176)..(176): n is a, c, g, or t
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (647)..(647): a, c, t, g, unknown or other
  misc_feature (647)..(647): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtntccagtgtcaagtgcaactggtggagtcgtgggggagcgtggtccagccgtgggagtcacagagactctcgtgtgcagccctcgtgggttccaccttcagtaactacggcatgcacgtcgggtccnccaaagcctaccgaggccgaaagggtnttgggaggttggggtggcgttaggtttcgtttcagttcgtggagggtctaggttgttacaaaagttgggtaatgacctagggacccttcgggtacgggaacgggtccgtacttaccgacctactcctaccgaagaacgtaacctaaacgttacccgaaaggaaaccctaagtaaagttaggtttaaacgggttttgggaacgttaccgttaacggaaacctacggtaccttaacggtacccgtaggaacggtaccgtacggggtactaacgttaaccgttacggtagggttaacgggaaaggggaacgggggaaccgngggacgggtaacttacgaagtacctcgttacgtaacgttcggtaaccgggg

SEQ ID NO: 332390 - DNA, 679 bp, Homo sapiens
  misc_feature: GZ8MTXP01EZ1LF.8.34.D01.1.454.CMB.2.raw
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggaggtcacagagactctcgtgtgcagcctcgtgggttcacctcagtaactacggcatgcacgtgggccnccaagctaccgaggacgaagggggtnttgggaggtgggggtgctaggtttgtttcacttcgtaggagggctaggttcgttacaagtgggtaatgacgtaagtacctccgggtagggaacggggccgtacttacaccctagttcctaccgaagtacgaactaacgttaccgaacggtaaaccaacgtaacgttaggtttaacgtttgggaacgtcgttacgaaacgtacggtacccgtaaagtcccgtaggacgggaccgtaacgggtacgttacgtaacgttacgtaggtaacgggaaacggggacgggggaaacccgtaagggtaccggggtaacgtaaccgtaacggttaccgttaaccgtttaacggtaacccgggg

SEQ ID NO: 332391 - DNA, 588 bp, Homo sapiens
  misc_feature: GZ8MTXP01BL36Z.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgctacgtatcctggtaccaacagaaacctggccaggcctcccacggccccctcatctatggtgcatccaacacgggcccagtcggcatcccagccaggttcagtcggcaggtgggtatgggaacagtctcactctacaccatcaatcagcctggcgcctggaaggtattgttgacttagtttacttacgttcgtactaactagttccgtacggtaggtcggcccgtccgggggtccctacggtttcccggcccgtcggggaaccctaaaggtcgggactacgttacgaaaccgtaacgttcggttcgacgtcgctaaccgtactcttcgttccttcgttaacc

SEQ ID NO: 332392 - DNA, 710 bp, Homo sapiens
  misc_feature: GZ8MTXP01A50K1.8.34.D01.1.454.CMB.2.raw
  modified_base (211)..(211): a, c, t, g, unknown or other
  misc_feature (211)..(211): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgttcttcgtctccgaaggggaaanacgccaccctctcctgcgaggccagtcagatgtgcgtctagtatcctagaccaacacgaaacctggccaggcctcccacggcccctanactctagtggtcncagtcccaaacgagggccctacgtggacctacgtcccagtcccgtaggttcaggtcggcgtaggggttgggatacggggaactaggtccttacgactctaccgaacctataccactcacggccgtgggacgtccgttaggtaaggtgttggtttacgacgtttaagtttacttacgttacgtaactaacgtacgtttaccggaacccgggtaggttccccgggccccgggttaccgggggttccccttaaccgggttttccccgggggaccccgttaagggggaacccgtaaaagggttcggaaacttaccgttaaaccgaaaaacggttccgttaggggttaccggttacgtaaccacttaaccggtattccgttaggttcccgttaactaaccccg

SEQ ID NO: 332393 - DNA, 810 bp, Homo sapiens
  misc_feature: GZ8MTXP01DF3QD.8.34.D01.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (745)..(745): a, c, t, g, unknown or other
  misc_feature (745)..(745): n is a, c, g, or t
  modified_base (774)..(774): a, c, t, g, unknown or other
  misc_feature (774)..(774): n is a, c, g, or t
tcagctcgcgtgtccacgaccggtgctcgatttagatcgtctgtgttgggtttgggctgaactgggttttcctcgttgctcttttaagaggtgtccagtgtcaagtgcaactggtggagtcgtggggggaggcgtggtccagcctgggaggtcacagagactctcgtgtgcagcctctgggttcaccttcagtaactacggcatgcacgtgggtccncaagctccgaggcaagggnttggagtgggtgctagtttgttcatcgtggaggctagtgttacaaagtggtatgcaagtaccgtccggtaggaacgggtcccgtaattcccgaacctactcctacccgaagacgaactaaactttacccgaaggaaacctaacgtaaagttggttaacttttacgggaacgtacgttaacggaaaaccctacggtaaaccccgttaaaggttccccgtagggaaaaccgggtaacccgggtaaaccgggggtaccttaaaacgttaacccgttaaaccggtaagggttaaaccgggaaacgggggtaacggggggaaacccaagggtaccgggggtaaacgttacccgtaaacggttacccgttaccgttagggaccggttacggtaccgggggtaccggggtaaccggggttacccgtcgggttaccccaccgttcccgtccctacgacccgtccctaacccgaccgaaccgggtcccctaacgttcccggttccccgtttcccccgnggtccccgtcccttcggcccgttacccgnggtaaccgccgtacccgcggacgcgaaccgaaccgg

SEQ ID NO: 332394 - DNA, 624 bp, Homo sapiens
  misc_feature: GZ8MTXP01AZC23.8.34.D01.1.454.CMB.2.raw
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
  modified_base (283)..(283): a, c, t, g, unknown or other
  misc_feature (283)..(283): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (577)..(577): a, c, t, g, unknown or other
  misc_feature (577)..(577): n is a, c, g, or t
tcagctcgcgtgtccacgaccggtgctcgatttagatcgtctgtgttgggtttgggctgaactgggttttcctcgttgctcttttaagaggtgtccagtgtcaagtgcaactggtggagtctggggggaggcgtggtccagcctgggaggtcacagagactctcgtgtgcagcctctgggttcaccttcagtaactacggcatgcactgggtccnccaagctcaggcaagggnttggagtgggtgctagttgttcatctgagggctagtgtacaatggtatgnagactcgagaacggcattcaccatctacagacgacactccgagaacanaatgtattcgatctagaacanacctaagtccgagaggacacgggtctaagtactacgtaggtaacgaaagggggacgggggtaaccagggtcgggtaacgttaccgaaacgttaccgttcgttacggaacggttcgggtacggggacccggtaacggggtaccccgttcgggtaccctaccggtcctccgtaccgacgtcccctacccgaacccgacgggccccaacgtcccggttccctccccgnggcccgccgttacgccgttcgcggcgccctccgcgagccgcgaaccg

SEQ ID NO: 332395 - DNA, 732 bp, Homo sapiens
  misc_feature: GZ8MTXP01A7VF6.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgttgcgcctacgtatcctgtaccaacagaaacctggaccaggcctcccgacggccccctcactcctagtcggtgaccactacccaaaccgacggggacccaacgtgggacccacgtcccccgaaggcccctaaggttccagggttcggaccgtaggggtaggggtaagtcgggggaaacctaggtaaccctttcaacccgttctacccgaaccctactacacttaccgaacgtccgtagggaacgtcccgtaggaacggggtatttggttacgaccgtttagtttaacgttacgttggttaaccgaaacgttacgttaccggtaacccggtagggttcccgggcccggttcccggggggaaccctttaccggtttcccgggtcccgttaacggggaaccctaaaggtcgggttaaattacgttaaaccgaaaacggtcgttaggcggacttcggaccctaacctagtccgttacgttccttcgttaacccg

SEQ ID NO: 332396 - DNA, 722 bp, Homo sapiens
  misc_feature: GZ8MTXP01AUSKJ.8.34.D01.1.454.CMB.2.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
tcagctcgcgtgtccacgaccggtgctcgatttagatcgtctgtgttggggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaaggggaaanacgcccaccctctcctgcgagggccagtcagatgtggcnctagtatctagacaanagaacngaccaggctcccagccctnatctagtggtnactactaccgaacgagggacccacgtcggacaccgtcccgacggtaccgtaggttcgacggttcgggacctaggggttaggggtacgtggggaaacctaacgggtcctttaccgaacctttcacccaccgtattacgactcacgtcccgaggggacaccgttagggaaaggtttcgttacggttacgtaacgtttaagtttaacgttacgttacgtaacctaaacggttacggttaacccgggtaaccgggtcgggttaccccgggtccccgggttaccgggggtacccgttacccggttcccggggaacccggttaacgggaaaccgtaagggttcgttaaactaacgttaaacgtaaacggtcgttggcgttacctaacggtacctaacttcgttcgttccttaacgttcctaaccg

SEQ ID NO: 332397 - DNA, 741 bp, Homo sapiens
  misc_feature: GZ8MTXP01BKN61.8.34.D01.1.454.CMB.2.raw
  modified_base (172)..(172): a, c, t, g, unknown or other
  misc_feature (172)..(172): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagnggtgtccagtgtcaagtgcaacgtggtggagtcgtgggggagcgtggtccagccgtgggagtcacagagactctcgtgtgcagcctcgtggttcacttcagtaactcggcatcgcacgtcggtccncaagcctccgaggcgaaggnttgggagtgggtgtctagtttgttcagtcgtggagggctaggttgtacaaagttgggtaatcgacgaggtaccgttaccgggtagggaaacggggtccctatttacccgacctactacctacccgaagaacgtactaaacttaccgaaaggaaaccaagtaagttagttaaggggtttacggtaagtaccgtaaacgtaaaccgtaacgtacccgtaaaggttacccgtaggaaccggggaaccgtacggggtaaccgttaaacgttaacgttaaccggttaagggttaaaccgggggtaaacgggggtaaccggggggaaaccgttacggggttaccgggggtaaccgtttaacccggtaacggtttaaccccgttcgggttttaacccggtaaccgggtttcccggggtaaccccgggggg

SEQ ID NO: 332398 - DNA, 401 bp, Homo sapiens
  misc_feature: GZ8MTXP01E1Q93.8.34.D01.1.454.CMB.2.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (348)..(348): a, c, t, g, unknown or other
  misc_feature (348)..(348): n is a, c, g, or t
  modified_base (391)..(401): a, c, t, g, unknown or other
  misc_feature (391)..(401): n is a, c, g, or t
tcagctcgcgtgtccacgaccggtgctcgatttagatcgtctgtgttggcgcctacgtatcctggtaccaacagaaacctggccaggctcccaggcccctcatctatggtgcatccaacagggccactggcatccccagccaggttcagtggcagtgggtatgggacagacttcactctcaccatcatcagcctggancctgaggatgttgctagttttatactgtacaaacntcgtaccgaggttcggcccgtccgggggcctacgtttcggccctgggaaccaaagtcggatactacaaacgaactgtgctgcaccatctgtcttcacttctcccgctatctaganacccacgcgagctggaacgcgggctgggacaagggcacatagnnnnnnnnnnn

SEQ ID NO: 332399 - DNA, 571 bp, Homo sapiens
  misc_feature: GZ8MTXP01DBSGW.8.34.D01.1.454.CMB.2.raw
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (407)..(407): a, c, t, g, unknown or other
  misc_feature (407)..(407): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctcgtgggttcacctcagtaactacggcatgcacgtgggtcccaccaagcctccgaggcaagggnttgggagtcgggtgctagttgttcagtctgagggcagtnttacaagtggtaatgcagactcgtagacggtcatcacatcacaganacataccagaacacaagtcgttattacgacctagaacacgacctaagtccgtgaacggacgacgggtaataattactacgttaggtaaccggaaggggttacgggggaacagggcgggtaacgttaaccgtaacgtacttaccgttaacggaacgttaaccggg

SEQ ID NO: 332400 - DNA, 588 bp, Homo sapiens
  misc_feature: GZ8MTXP01CK390.8.34.D01.1.454.CMB.2.raw
  modified_base (261)..(261): a, c, t, g, unknown or other
  misc_feature (261)..(261): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactgatggagtcgtgggggagcgtggtccagccgtgggagtcacagagactctcgtgngcagcctgtggtcaccttcagtaactacggcatcgcacgtcgggtcccaccaagcctacgaggcgaagggtgttgggaggtgggtggcgtagtttcgttcagtcgnggagggctagtcgtactaagtgggtancgcgagacgtcgtagaacggcgtatccactatccacagacgaactaacttacaaggactaactaagttgttagttggagtctagaacacgtacctaagtcagggaacgacgacgggtacttacgtaacgtgttacggacgggaggggaacgggggaccaagggacgggtacgttacgtaacgttcgttaaccgg

SEQ ID NO: 332401 - DNA, 746 bp, Homo sapiens
  misc_feature: GZ8MTXP01BM75P.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctgggaggtcacagagactctcgtgtgcagcctcgtgggttcaccttcagtaactacggcatgcctacgtcgggtcccacaagcctaccgaggcgaagggtattgggagtgggtgcgtagtttcgttcagtcgtaggagggctaggttgttacaaaagttgggtaagtgacgtacgtaccttccgggtagggaacgggtccgtacttcacctatccgtaccgaagtaacgaacctaacgttacccgaaagggaaaccctaacgtaaacgtttaggtttaaggttttacggggaacgtaccgttaacggaaaccgttacggtaaccccgtttaaaggtccccggttaagggaaaccggggtaaccgaaccgggggttacgttaaacgttaaccgttaacggtaacggggttaaacccggggaaagggggtaacgggggaaacccgttgggttaccgggggttaactttacccggtaagttacccgttaccggttttacggaacccggttcgggttaaccgggg

SEQ ID NO: 332402 - DNA, 589 bp, Homo sapiens
  misc_feature: GZ8MTXP01BA5EM.8.34.D01.1.454.CMB.2.raw
  modified_base (173)..(173): a, c, t, g, unknown or other
  misc_feature (173)..(173): n is a, c, g, or t
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggtttcctcgttgcttcttttaagnggtgtccagtgtcaagtgcaacgtggtggagtcgtgggggagcgtggtccagccgtggggagtcacagagactctggtgtgcagcctgtggttcacctcagtaactcggcatgcacgtggtccacagcctacgaggacaagggnttgggagtgggtgctagttnttcatcgtgngggtcagtgttacaagtgtactgcagtacgtcgtagaaacggcgtactacacagtctaccagacgtacaattaccgaacggaacaacgtagtgttagtttaggacgtacgtacgaaactgtaccgtaaacgtccgtagacggaaccgaacgggtacttacgtaccgttagtacggtaaccggaaggggcggggaaaccgtaaggccggtaagttaccgagttacctccgtttaaggtcccgg

SEQ ID NO: 332403 - DNA, 709 bp, Homo sapiens
  misc_feature: GZ8MTXP01CODYN.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcacgtcctcgtggttcaccttcagtaactcggcatgctacgtgggtcccacctaagcctaccgaggacgaagggtatttgggaggtggggtgctagtttgttccagtcgtggagggctaagttgttcaagttcgggtatcgacaggtaccgtccggtaggaacggccgtacttccgacctactcctacaagacgaactaacttaccgaagaaacctaagtaagtttacggtttagtttacgggaacgtaccgttaacggaaactaccggtaccttaacggtacccgttagggaaaccgggaaccggtaaccgggttacgttaacttaaaccggttaaacggtgggttaaaccgggggaaacgggggaaaccggggggaaacccgtacgggggtaacggggtaaccgtttacccggttaacggtttaacccgttccgggttttaaccggg

SEQ ID NO: 332404 - DNA, 591 bp, Homo sapiens
  misc_feature: GZ8MTXP01BXFQ7.8.34.D01.1.454.CMB.2.raw
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (430)..(430): a, c, t, g, unknown or other
  misc_feature (430)..(430): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgtaacttgggttttcctcgttgcttcttttaagaggtgtccagtgtcaagtgcaacgtggtggagtcgtgggggaggcgtggtccaggccgtgggaggtcacagagactcgtcgtgtgcacgtcctcgtggttccaccttcaacgtaactacggcatgcacgtcgggtcccaccaagcctccgaaggcgaagggtgttgggaggtgggtgctagtttgttcagtcgnggaggctaagttgtctaagtgggtangacgngtactcgagacggctactcacntactacgagacacagtacgagaacagtatgtagtgactcgagaactacgtacgtaacgtccgtagaacggaacgacggttactaacgacgtaacggtagaacggggaggggaacggggtaacgaggtaacgggtactacgttaacgtccgttaacgttcgg

SEQ ID NO: 332405 - DNA, 661 bp, Homo sapiens
  misc_feature: GZ8MTXP01CL3IO.8.34.D01.1.454.CMB.2.raw
  modified_base (593)..(593): a, c, t, g, unknown or other
  misc_feature (593)..(593): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggttccaccttcagtaactacggcatcgcacgtcgggtccaccaagcctaccgaggcgaaaggggtgttgggaggtgggggtggactaggtttgtttcagttcgtagggagggctaggttgttacaaaagttggtaatgacagtacctccggtaggaacgggcctatcaccactctaccgaagacgtaacacttaccgaagtaacaactaagttgttaagttggagtcgtaacgaacgtacgtaccgtaagtccgtaggaacgggaaccgtacgggtaacgtaacgtaaccgttagttacgggaaacgggaaagggggaacgggggaaacccgngggacgggggtaacttacccgtaaggttcccgttacggttacggtaaccggttcgggtaacccggggg

SEQ ID NO: 332406 - DNA, 690 bp, Homo sapiens
  misc_feature: GZ8MTXP01CLD7H.8.34.D01.1.454.CMB.2.raw
  modified_base (276)..(276): a, c, t, g, unknown or other
  misc_feature (276)..(276): n is a, c, g, or t
  modified_base (328)..(328): a, c, t, g, unknown or other
  misc_feature (328)..(328): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactcgtcgtgtgcacgtcctgtcggttcaccttnagtactacggcatgccacgtcgggtcccacaaagcctaccgaggcgaagggnttgggaggtggggtgctaggtttcgttacagtcgtggacgggctagttgtacaaaagttggtaatgacgtagtaccgtccggtagggaacgggtccctattaccgacctatcctaccgaaaggactaaacctaacttacccggaagtaaacaacgtaaattacggttaaggtttacgggaactacgttaaacgaaacgtacgtacccgtaaagtacccgtaggaacggtaccgacgggtcctaaagtacggttaacgtacgggttaacgggaaacgggggtacgggggaacccgttagggacccggggtaattaccggtaacgttccgttacgtttacgggaaccgttcgggtaacccgggg

SEQ ID NO: 332407 - DNA, 646 bp, Homo sapiens
  misc_feature: GZ8MTXP01A9IDR.8.34.D01.1.454.CMB.2.raw
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (598)..(598): a, c, t, g, unknown or other
  misc_feature (598)..(598): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccaggccgtgggagtcacagagactctcgtgtgcagcctcgtggttccacttcagtaactacggcatgctacgtgggtcccnccaaagcctaccgaggcaaagggtnttgggaggtggggtgctaggtttagtttcagtcgtggagggtctaggttcgttacgaaaagttgggtaactcggactaacgggaccgttcccgtagggaaacgggtccctacgttaccaccctatcctaccaagtaacgaactaactaccgagtaaaccaataagttagttaaggtttacggagtactacggaaatccgtaccgtaaagtcccgtagacggactacggggtctaataccgttagtgttaacggaagggacgggggaaccgnggacggtaacgtacgaacgttcgtcgttacgtaacgttcgtaacgggg

SEQ ID NO: 332408 - DNA, 836 bp, Homo sapiens
  misc_feature: GZ8MTXP01A3HOF.8.34.D01.1.454.CMB.2.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgccaccctctcctgcagggccagtcagatgtgcnctagtatcctggtaccaacagaaacctggccaggcctcccgacggcccctnatcctatggtgactactcccgaaacgacggggcccctagtcgggacctacgtccccgaaggtccccgtaaggggtttccaagggtttcgggaccgtaggggtttagggggtaacgttcgggggaaaacctacgggtaaccctttccgaacccttacccgttaccaaaccctatccgtaaacttaccgaacggtcccgttacggggaacgtcccgtagggtaacgggtagtttcgggtttacgtacgttaacgtttttaacttaaccgttcggttaacccgtaaacgttaacggttaccccgggttaacccgggtacgggttcccgggggtcccccgggtttaccccgggggggtacccctttacccggggttttaccccgggggacccccggttaacgggggtaaaccccggtaaaaggggttacggggttaaacttaaccggttaaacccgaaaaaccgggtaacgttcgggttacggaccgttcggaaccctaacccgtaacgttcccggttactttccgtttaaccgtttaaccccg

SEQ ID NO: 332409 - DNA, 808 bp, Homo sapiens
  misc_feature: GZ8MTXP01C459V.8.34.D01.1.454.CMB.2.raw
  modified_base (300)..(300): a, c, t, g, unknown or other
  misc_feature (300)..(300): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactcgtcgtgtgcagcctcgtgggttcaccttcagtactacggcatgcacgtcggtccnccaagcctccgaggcgaaagggtgttgggaggttggggtggacgttaggtttcgtttcagttccgtggacgggtctaggttcgttacctaaaagttgggtaagtcggaccgtaacgggtaccccgttacccgggtaggggaaaccgggggtcccttaactttacccgaaccctacgttaccgttacccgaaaggtaaacggtaaccttaaaccttaacccggaaacgggtaaacctaaacgtaaagtttaggtttaaaggttttacgggaacggtaaccttaacggaaaccgtaacggtaaccccgttaacggtaaccccggttaggaaccgggtaaccgaaccggggttaacgttaaacgttaaccgttaaacggttacgggttaaacggggaaaacgggggtaacggggggaaacccgttacggggttaccggggtaacggtttaccgtaaacgggtttacccgttaccgggtttacggtaaccgggttccgggttaacccggggg

SEQ ID NO: 332410 - DNA, 761 bp, Homo sapiens
  misc_feature: GZ8MTXP01DHH8K.8.34.D01.1.454.CMB.2.raw
  modified_base (336)..(336): a, c, t, g, unknown or other
  misc_feature (336)..(336): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtggtccagccgtgggaggtcacagagactctcgtgtgcagcctgtggttcaccttcagtaactacggcatgcacgtcgggtcccgaccaagcctccgaggacgaagggtntttgggaggtggggtggctagtttcgtttccagttcgtggacgggtctaaagggttcgttaacgaaagttggggttatcggaccgtaacggtaccgtaccggtagggaacggggtaccgtaacgttccaacctactacccgtaccgaacggtaacgaaactaaacgttacccgaaagggtaaaccctaaacggtaaagtttaggttaagtttacgggaacgtaccgtaaacggaaaccgtaaccggtaacccgttaaacggttacccgtagggtaaccgggaaccggtaaccggggttacgttaaacgttaacgtaacggtaacgggttaaacggggaaacgggggaaccggggggtaaaccgacggggtaaccgggtaacggttacccgttaaacggttaacccggtttaacgtttaaccgggg

SEQ ID NO: 332411 - DNA, 551 bp, Homo sapiens
  misc_feature: GZ8MTXP01COKDF.8.34.D01.1.454.CMB.2.raw
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
  modified_base (497)..(497): a, c, t, g, unknown or other
  misc_feature (497)..(497): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtatcctggtaccaacagaaacctggccaggctcccagccctnatctatgncatccaanacggccatggcatccagccaggttcagtcggcagtggtatgggaacagaacttcaaccttncaaccatcatcanccctgagcctgaggatggttanattagtttattactgtacgaactagtacgtacgagtcggccggtccgggtacctacgttccggacccgtacgggaaccgtaaagtcgataanaacgtaaacgtaacgttagttcgcgtcgacaactactcgttactcgttcgtaac

SEQ ID NO: 332412 - DNA, 673 bp, Homo sapiens
  misc_feature: GZ8MTXP01DDIGX.8.34.D01.1.454.CMB.2.raw
  modified_base (272)..(272): a, c, t, g, unknown or other
  misc_feature (272)..(272): n is a, c, g, or t
  modified_base (317)..(317): a, c, t, g, unknown or other
  misc_feature (317)..(317): n is a, c, g, or t
  modified_base (601)..(601): a, c, t, g, unknown or other
  misc_feature (601)..(601): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtgtccagccgtgggagtcacagagactctcgtgtgcacgtcctcgtggtcaccttnagtaacacggcatgcacgtgggccacgaagctccaggcaagggtntgggagtgggtgctagtttgttcagtcgtggagggctaggtgttacaaagttggtaatgacaggtacctccggtaggaacgggtcctattcgacctagtcctccgaagaacgtaacctaattaccccgaaaggaaacctaacgttaaagttaggtttaagtttacgggacgtacgttacgaaactacggtaccttaaaggtcccgtaggacgggtaccgacggggtactaactaacgttaacgtacgggttaaacgggaaacgggggaacgggggttaaaccgnggggttaaccgggtaacgttaaccgtaaggtttacccgttcgtttacgggtaacgttccgggtaaccggggg

SEQ ID NO: 332413 - DNA, 853 bp, Homo sapiens
  misc_feature: GZ8MTXP01DSNF1.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgtgcagcctcgtggttcaccttcagtaactcggcatgcacgtcgggccaccaagcctaccgaggacgtaaagggggtagtttggggaggtggggtacgcgtaggttttcgtttaccccagtttcgagggacgggtcgtaaaggttacgttcgaaagttgggttaaactcggaaccgtaggtaacccgttaccgggtaagggtaacggggtaccgttaacttacccaacccgttaactacccgtacccgaaacggtaacggtaaaccttaaaaccgttaacccggaaaacgggaaaccctaaaccggttaaacggtttaacggtttaacgtttaaggggaaccgtaccggttaaacgtaaaacccggtaacggtaacccgttaaaccggttacccggttaagggaaccgggtaaccggtaaccggggttaaccgtttaaacggttaaacccgtttaaaccgggtaacgggttaaaacccgggggaaaagggggttaaaccgggggggaaacccgtaaaccgggggtaaccggggttaaaccggtttaacccggttaaacgggtttaacccgtttaacccgggttttaaccgggg

SEQ ID NO: 332414 - DNA, 915 bp, Homo sapiens
  misc_feature: GZ8MTXP01AU5CR.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagccgtggggaggtcacagagactctcgtgtgcagtccctcgtcgggttcctaccttcgaagtaaccgtacggcagtcgccacgtcgggtcccaccaaagcctaccgaggacgtaaaggggtacgttggggacggttgggggtcggtacgttaggttttcgtttacgaagttcgttacggggaggggtcgtaggtttacgttacgtaaaaaaggttgggtaattcgggaccgtaaacggtaccgttcccgggttaacggggaaaccgggggtacccttaacgtttacccaaaccccgttaacgtacccgttacccgaaaggtaaaccggtaaaccttaaaccgttaaccccggaaacgggttaaaaccctaaaccgttaaaacggtttacgggttttaaacggggttttaaggggaaccgttaaccggtaaaccggtaaaaccgtaaccggttaaccccgtttaaaacgggtaccccggttaaggggaaaccggggtaaaccggtaaccgggggttaaccggttaaacgttaaaccgttaacgggtaaaccgggttaaaacgggggaaacggggggaaacggggggttaaacccgttacgggggttacccgggtttaaacgtttaacccggtaaacggtttacccggttacccggttttacgggtaaccgggtttcccgggtaacccgggggg

SEQ ID NO: 332415 - DNA, 645 bp, Homo sapiens
  misc_feature: GZ8MTXP01AILA5.8.34.D01.1.454.CMB.2.raw
  modified_base (316)..(316): a, c, t, g, unknown or other
  misc_feature (316)..(316): n is a, c, g, or t
  modified_base (430)..(430): a, c, t, g, unknown or other
  misc_feature (430)..(430): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacgttgggttttcctcgttgcttcttttaagaggtgtccagtgtcaagtgcaacgtggtggagtcgtgggggaggcgtggtccagccgtgggagtcacagagactctgtgtgcagcctgtggtcacctcgaagtaacgtacggcatcgcgtacgtgggtcccaccgaacgtcnccgaggacgaaagggggtagtttgggacggtggggtggcgttagtttgtttcagtcgtggaggtctaggttgttacaagtggtatgcacgtctcggagacgggctattacaccnctctaccgagacacaacttccgaagaactaacgagttcgttagttggaactcgacgaacacgtaccgttaacggtaccgtaggacggtaccggccggttacgttaacgtaaccgttaacggtacggggtaaacgggaacgggggaaccgggggttaaccgaaggggtacgggtaacgttaccggtacgttaccgtttaacgttcgggtaaccggg

SEQ ID NO: 332416 - DNA, 643 bp, Homo sapiens
  misc_feature: GZ8MTXP01ACU0O.8.34.D01.1.454.CMB.2.raw
  modified_base (172)..(172): a, c, t, g, unknown or other
  misc_feature (172)..(172): n is a, c, g, or t
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaacgtggtggagtcgtgggggagcgtggtccaggccgtggggagtcaacgagacgtactcgtcgtgtgcagcctgtggtcacctnagtaactcggcatgccacgtcggtccncaagcctaccgaggcgaagggtnttgggaggttgggtggactagttcgtttcagtcgtggacgggtnagttcgttacaagtcggtatcgacgtagaccgttcggagggaacgggtctattaccaacctatcctaccgaagaacgaactaaacgttaccgaaggaaacctaagaaaggtttgtaaagtttgggactacgtaagaacgagtacctaaagtcccgtaagacggtacgaacggggtcttaacggtacttacggtaggtaacgggaacgggggacggggaacccgaaggtacgggtaacgttacccgaggttacccgtcgtttaacggaaccggg

SEQ ID NO: 332417 - DNA, 740 bp, Homo sapiens
  misc_feature: GZ8MTXP01DSTN9.8.34.D01.1.454.CMB.2.raw
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagccgtgggagtcacagagactctcgtgtgcagcctcgtggttcaccttcaagtaactacggcatcgcacgtcgggtcccacaagcctaccgaggcgaaaggggtntttgggaggtgggtgctaggttnttccatcgtggacggtctaaagttgttaacgaaagttgggtaatggaccgtaagggtacccgttacccgggttagggaaacgggggtccccgtaaacgtttacccgaaaccctacgttaccccgttaaccccgtaaaggaaccggtaaaccctaaacgtttaccccgaaaagggtaaaccctaaacggtaaagtttaggtttaaacgtttagggaacgtaccgtaacgaaacgtaacgtacccgttaaaggtacccgtaggaacgggtaaccgaacgggttacgttaaacgttacgtaacgtacggttaaacgggaggggttaaaccgggggaacgagggtaacgggtacgttaccgttaagttccgttcgtttaacggg

SEQ ID NO: 332418 - DNA, 721 bp, Homo sapiens
  misc_feature: GZ8MTXP01CWZJ5.8.34.D01.1.454.CMB.2.raw
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagcctgggagtcacagagactctcgtgtgcagcctcgtgggttcaccttnagtaactacggcatgcacgtgggcccnccaagcctaccgaggcgaagggattggagtgggtgctagttgttccagtcgtggagggctaaggttgttcaaagttgggtaatggaccgtaaggtacccgttccggtagggaacgggcccgtattacccgaccctaacgtcctacccgaagaacggtaaacctaaacgttacccgaaagggtaaacccaaacggtaaacgttaggtttaacgtttaaggggaacgtaccgttaacgaaaccgtaacggtaccccgtaaaggttccccgttaggaacgggtaaccgtaaccgggggttacgttaacgttaacgttaaaccggtagggttaaacccggggaagggggaaccggggggaaaccacggggtaacgggtaacggttaccggttaacgttaaccgttccgtttaacggg

SEQ ID NO: 332419 - DNA, 655 bp, Homo sapiens
  misc_feature: GZ8MTXP01CUHPH.8.34.D01.1.454.CMB.2.raw
  modified_base (307)..(307): a, c, t, g, unknown or other
  misc_feature (307)..(307): n is a, c, g, or t
  modified_base (535)..(535): a, c, t, g, unknown or other
  misc_feature (535)..(535): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtcagcctgggaggtcacgagagactcgtcgtgtgcacgtcctcgtcgggttcaccgttcaagtaactacggcagtgccacgtcggtccnccaagctaccgaggacaagggattgggaggtgggtggctagtttgtttcagtcgtggaggcagttgttacaaagttggtaatgctaggtacccgtcgggtacggaacggggtccctagttccaaccgtattaccgtacccaaggaactaacgtaaacttaccgaaacggaaactaacgaagttacgttaggttaggacgtactacgaaacacgtaccgtaagtaccgngtaacgggacctacggggactaagtaacgttacgtacggttaacgggaaaggggacgggggaaacgaggacgggtaagtaccgtaacggttctcgtttacgaacggttcggtaaccgggg

SEQ ID NO: 332420 - DNA, 833 bp, Homo sapiens
  misc_feature: GZ8MTXP01ELJZN.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtggggagtcacagagactcgtcgtgtgtacgtcctcgtggtcctacttcgaagtaacgacggcatcgactacggtcgggtacccacgaagcctaccgaggcggaaaggggtagttgggggaggttgggggtacgtcgtttaaggttttcggtttacacgttcggtaggtaacgggggtccttaaggtttccgttaacgtaaggtttaacgggtaagtttcggaaccgtaacgggtaccccggttacccgggttaggggaaacccgggggtacccttaacgttaacccgtacccgttaacgtcccttaaccggtaaacgggaactaaaaccgttaaccgtttaaacccgaaacgggaaactaaaccgtaaggtttaacggtttaggtttaaggggggactaaccgtaggtaaaccgaacgttacccgtaaacggttcccgtaagggacggaaccggtacggggtaacttaaccgtaaacgttacggttaagggtaaccggggttaaacgggggaaacgggggtaaccaggggttacggttaaccgttaaccgtaacggttaaccgtttcggttacggttacggttccgggtttcggggaaccccggg

SEQ ID NO: 332421 - DNA, 641 bp, Homo sapiens
  misc_feature: GZ8MTXP01BCPKP.8.34.D01.1.454.CMB.2.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtggggagtcacgagagactctcgtgtgcagtcctgtggttcacctnagtaactcggcatgcacgtcggtcccnccaagcctccgaggacgaagggtnttgggaggttggggtgcttaggtttcgtttacagttcggtggagggtctaggttcgttacaagttgggtatgacaggtcctcggtaggaacgggtctattccactatctaccgagacaactaacttccgaagaactacaaggttcgttaagttcgatcgtaacgaaacgtcgtaaccgtagtccgtagaccggaacggtaacgggtacttaagtaccgttaacggtacgggaaaccgggaagggggacggggaacccgtaaggggtaccgggtaacgttaaccgacggtttaccgttcggtttaacggaacccggg

SEQ ID NO: 332422 - DNA, 724 bp, Homo sapiens
  misc_feature: GZ8MTXP01ASC1F.8.34.D01.1.454.CMB.2.raw
  modified_base (211)..(211): a, c, t, g, unknown or other
  misc_feature (211)..(211): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (290)..(290): a, c, t, g, unknown or other
  misc_feature (290)..(290): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaaggggaaancgcccaccctctcctgcagggccagtcagatgtgcgctagtntcagtaccaanagaacctgcaggctcccacggccctnatctagtggtgccatcccaaagcgggaccacgtggaccactccccgagccgtaggttcgaggtcggacgagggttcgggtaagtcggggaaactacgtaaccttccactcctcaccatactactccagtcccgtagggaccgtaccgtagggtagggtacttggtttacggacctttaaggttttaactacgttacggttaaccaaacgttccgttacccgggtaaccgggttacgggtcccgggttccccggggttcccgggggtaaccccgtttacccgggttttcccgggggaacccccggttaacgggggaaaccccgtaaaaggggttcgggttaaaccttaaacggttaaacccggtaaaaccggtaaccgttgggttcgaccgttcggacctaaccctaggtccttacggttcttccgttaaccccg

SEQ ID NO: 332423 - DNA, 726 bp, Homo sapiens
  misc_feature: GZ8MTXP01APH5Y.8.34.D01.1.454.CMB.2.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggagtcacagagactctcgtgtgcagcctcgtcgggttcaccttcagtaactacggcatgcacgtcgggtccnccaagctaccgaggcgaagggnttgggaggtggggtggctaggtttgttcatcgtaggagggtctaggttgttacaaaagttgggtaatgacgaacgtaccgtccgggtaggaacggggtcccgtattcccaaccgtacttccgtaccgaagaacgtaaccgtaaacgttacccgaaaggtaaaccaacgtaaagttaggttaaggtttagggaacgtacgtaacggaaaccgacggtaccgttaacggtacccgtaggtaacgggtaaccgaaccggggtacgttaactaaccggttaacgtacgggttaaacgggtaaacgggggaacggggggaaaccgttacgggggttaccggggtaacggttacccgtaacgggttaccgttccggtttacgggtaaccgggttcgggtaacccggggg

SEQ ID NO: 332424 - DNA, 637 bp, Homo sapiens
  misc_feature: GZ8MTXP01APIO1.8.34.D01.1.454.CMB.2.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaagggaaancgccaccctctcctgcgagggccagtcagatgtgcnctagtntcctgacacagaacngccagctccagccctnatcatggtncatccaagnggccangacnctccagcctgtcagtcggctaggtggtatgggaacagtcttcacttctaccaactatacaactcgacgcccgtagggacgtaccgtagggtaaaggttactttcgggttagtaccgttaaagtttacgttacgttcggtaacgtaaacttcggttacccggtaaccgggtcggtcccgggccccgggttacccgggggtacccttaccggtttcccggggacccgttacgggaaacccgtaaagggttcggaaacttaaccgttaacgaaacgtaccgttgggttcggaccttcgacctaacgtcttcgttcttccttaacgtcccg

SEQ ID NO: 332425 - DNA, 730 bp, Homo sapiens
  misc_feature: GZ8MTXP01AC1IW.8.34.D01.1.454.CMB.2.raw
  modified_base (303)..(303): a, c, t, g, unknown or other
  misc_feature (303)..(303): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagacgcccaccctctcctgcagggccagtcagaatgttggcgtcctagtatcctggtaccaacagaacctggccaggcctcccgaggccccctnactctagtggtgccatacccgaaacgcgggaccctagtcggaccactacccccgagcccctaagggttccaaggtccggacagggtgggtactggggaacaggtccttcacctctaccacctatcactaccgacgtcccgtaggggaccgtccgtagggtaacggggtatttgggtttacgtacgtttaaggttttaacttaccgttacggttaacctaaacgttacgtttacccgggtaacccgggttagggttccccggggtccccggttccccggggggtaccccttaacccgggttttccccggggaccccggttaacgggggaaccctaaagggtccggttattaaccgttaaccgaaacggtaaccgttgggttcgccgttcgaccaaccgttagtccgttacgttccttaaccgttcccg

SEQ ID NO: 332426 - DNA, 742 bp, Homo sapiens
  misc_feature: GZ8MTXP01AQX4G.8.34.D01.1.454.CMB.2.raw
  modified_base (389)..(389): a, c, t, g, unknown or other
  misc_feature (389)..(389): n is a, c, g, or t
  modified_base (422)..(422): a, c, t, g, unknown or other
  misc_feature (422)..(422): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggagcgtggtccaggccgtgggagtcacgagagactctcgtgtgcacgtcctcgtggttccaccttcaagtaactacggcagtcgcacgtcgggtaccccaccaagccctaccgagggaccgaaggggtatttgggaggtgggggtcgacgttaggttttggtttaccnttacggtgaaggggtcctaaagggttcgttaanaaagtgggtaatcgtacgagtaccgttcccgggagggtaacgggtccgtacttacccaacctaacttacccgacccgtaaaggtaaccgtaaaccttaaacgttacccgaaaaggtaaaccccaacgggttaaagtttagggtttaagtttacgggaacgtaccgttaacggaaaccgaacgtaaccgtaaaggtcccgtaaggaccggtaacgacgggttacgtaaacgttaccgtaaacgtagggttaacgggaaggggacgggggaaaccgaggggaacgggttaacgtacccgttaaggtcccgttcgttaacggg

SEQ ID NO: 332427 - DNA, 609 bp, Homo sapiens
  misc_feature: GZ8MTXP01B0RJA.8.34.D01.1.454.CMB.2.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagcccaccctctcctgcagggccagtcagatgtgcnctagtatcctgtacaacagaactggcaggctcccagccctnatctatggncactccaacgngggccagtggcatcccgagccnggttcagtcggctaggtgggtatgggaacagtccttnacctctacaccatcatcagcctggacnccgttagaaggttnttgtacgtattagtttactacgtacgtacgtaacgtacggtaccgtaccggtacggtccgggtccccgggttcccggggtacccttaccggttcccgggacccggtacgggaaccgtaaaggtcggttaaactacgttaaaccgaaacggtcgttggttcgttacgtaacgtacctaacgtcgtcgttcgttccttcgtccg

SEQ ID NO: 332428 - DNA, 595 bp, Homo sapiens
  misc_feature: GZ8MTXP01EGNRN.8.34.D01.1.454.CMB.2.raw
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (463)..(463): a, c, t, g, unknown or other
  misc_feature (463)..(463): n is a, c, g, or t
  modified_base (545)..(545): a, c, t, g, unknown or other
  misc_feature (545)..(545): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctcgtgtgcagcctctggtcacctnagtaactacggnatgcacgtgggtcccgccaaagctccaggacgaaagggtattgggaggttggggtgcgtagttgtttcgatcgtaggaggctagtgttacaagtggtacgtgcagtacgtccgtagacggtcgagttcactatctaccagacgacattaccaagtaacacaagtgtattcgganatagaactagacctaacgtccgtgacggacgaacggcgttataccgttagacggtaacgggaaggggttacgggggaaccgngggacgggtaacgttaccgaagttaccgttaacccggtttggtaaccggg

SEQ ID NO: 332429 - DNA, 701 bp, Homo sapiens
  misc_feature: GZ8MTXP01ATJ1Z.8.34.D01.1.454.CMB.2.raw
  modified_base (313)..(313): a, c, t, g, unknown or other
  misc_feature (313)..(313): n is a, c, g, or t
  modified_base (390)..(390): a, c, t, g, unknown or other
  misc_feature (390)..(390): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgtcttcttttaagaggtgtccagtgtcaagtgcaagtggtggagtcgtgggggagcgtggtccagccgtgggaggtcacgagagactctcgtgtgcacgtccttcgtcggttccaccgttcaagtaacacggcagtcgctacgtcgggtcccnccaaagcctaccgaggcgaaggggtagttgggaggtgggtggtactaggtttgttcagtcgtggacgggctaggttntacgtaaagttgggtaatcggtacgaacggtaccgttaccgggtaggggaaacgggtcccgtacttacccgaacctacgtcctaccgaagtaacgtaactaaacgttaccgaaacggtaaacaacgtaaagttacggttaaggttaggggtaacgtaaccgtaacggtaaaccgacggtaacccgtaacggtacgtacggaacggtaaccgcggtacgtaataacggttacgtaggaacggaaaggggtacggggaacgcgggacggtaacgtaccgtaacgttcgtacgttacgcggttccggtccgggg

SEQ ID NO: 332430 - DNA, 750 bp, Homo sapiens
  misc_feature: GZ8MTXP01ARV0Q.8.34.D01.1.454.CMB.2.raw
  modified_base (274)..(274): a, c, t, g, unknown or other
  misc_feature (274)..(274): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgtgcagcctcgtgggttcaccttnaagtaactacggcatcgcacgtcgggtcccaccaaagcctaccgaggcgaaaggggtattgggaggtggggtggcttaggtttcgtttacgagtcgtagggaacggggtctaggttagttacgaaaaagttgggttaactcggtaccgaaacggtacccgttacccgggtagggaaacggggtcccgtaacttccgaacccgtaatccgtacccgaagtaacgtactaaacgttcccgaaaggtaaaccaactaagttaggttaacggtttaggaacgtcgttaacggaaactacggacccgttaaaggtcccgtaaggaaccgggtaacgtaccggggtacctaaacgttaaccgttaacgtacggggttaaccgggaaagggggtaaccgggggaaaccgttggggaccgggtaacggttacctaacggttaccgttaccggttacgggtaaccggttcgggtaaccccggggg

SEQ ID NO: 332431 - DNA, 395 bp, Homo sapiens
  misc_feature: GZ8MTXP01EM6SZ.8.34.D01.1.454.CMB.2.raw
  modified_base (342)..(342): a, c, t, g, unknown or other
  misc_feature (342)..(342): n is a, c, g, or t
  modified_base (381)..(381): a, c, t, g, unknown or other
  misc_feature (381)..(381): n is a, c, g, or t
  modified_base (386)..(395): a, c, t, g, unknown or other
  misc_feature (386)..(395): n is a, c, g, or t
tcagctcgcgtgtccacgaccggtgctcgatttagatcgtctgtgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgaggtcggcccgtccggggggcctacgtttcggccctagggaaccaaaggtggatatacaaacgactgtggctgcacatctgtcttcactcttcccgccattccngacgaccacgcgagctgaacgcgggctagggcaaggccngatgnnnnnnnnnn

SEQ ID NO: 332432 - DNA, 654 bp, Homo sapiens
  misc_feature: GZ8MTXP01BZPGA.8.34.D01.1.454.CMB.2.raw
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacctgtcttcgtctccgagggaaancgccaccctctcctgcgaggccagtcagatgtgcncctagtntctagacanagaacngcngcnccacgcccnatctagtgtgcactaccaacgcgggaccacgtcgaccactcccgacgaccgtaggtccaggtcggacgtaggtggggtagtggggaacaggtcctcacctctaccacctactacactacacgtccgtagggacctccgtaggaacgggttattcggttacgtaaccgttagttttaacttacgtacgttaacctaaacgtacgttaccggtaccggtacgggtcccgggtaccccgggttcccggggaccccttccggtttccccgggccgttaacggggaacccgtaaaggtacgttaagtaccttaaccgtaaaacgtaacgttcggcggttctaacggcctaacgtacgttcgttcgttccttcgttaaccc

SEQ ID NO: 332433 - DNA, 561 bp, Homo sapiens
  misc_feature: GZ8MTXP01DKQD0.8.34.D01.1.454.CMB.2.raw
  modified_base (258)..(258): a, c, t, g, unknown or other
  misc_feature (258)..(258): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (436)..(436): a, c, t, g, unknown or other
  misc_feature (436)..(436): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagcctgggagtcacagagactctgtgtgcagcctntgggttcaccttcaagaactacggcatgcacgtcgggccaccaaagctccagggcaaagggnttgggacgtggggcgctagttgtttcatcgtgagggnagtgtcaaaatggtngcagctcgagaacggcatcacntcacaganacatacaagaacatagtgttagttgacgcagaanagacgtaacgtactagaggacgacggacgtaactaacgttacgtacgttaacggaaagggaacgggggaacggacggacgggaacggtacgtaacgttacgtacgttacgtaacgttcggtcggg

SEQ ID NO: 332434 - DNA, 621 bp, Homo sapiens
  misc_feature: GZ8MTXP01BQUZF.8.34.D01.1.454.CMB.2.raw
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagcccaccctgtcttcgtctccgaggggaaanacgccaccctctcctgcgagggccagtcagatgttggcgcctagtntcctgaccaanagaactgcaggctccagccctnatctatggncactaccaacgacgggcccacgtggaccctactccccgagtccgtaggttcaggtcggcgtagggtgggtagcgggaacagtcttcactctacactatcatcagccgtaggacgtcgtaggacgtattgttcgacttagtttactacgtacgtacaaactcggttaccgtaccggtaggttcccgggcccgggttcccgggggaccctttaccggttcccggggaccccgtaggggaacctaaagggtcgttaaatacgttaacgaaacggtcgttgggttcgacgtcgaccgtaacctatcgttcttccgttcgtaacccg

SEQ ID NO: 332435 - DNA, 699 bp, Homo sapiens
  misc_feature: GZ8MTXP01B41L5.8.34.D01.1.454.CMB.2.raw
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtggggggagcgtggtccagccgtggggaggtcacgagagactctcgtgtgcagcctcgtggtcactcagtaactacggcatgcacgtgggcccncaacgctccgaggcgaagggtntgggagtgggtggctaggttgttcattcgtggagggtctaggttacgttacaaggttgggtaaatggtaccgtagggtaacccgttcccgggtaagggaaccggggtaccgtaacgttacccgaacccgtaacttcccgtacccgaacggaacggtaacctaaacgttacccgaaacgggaaacctaaccgtaaacgggttagttaaggtttagggacgtacgtaacgaaacgtacgtaaccgttaacgttccgtacggtacggacgaacgggtacgttaactacgttacgtagggtaacggaacggggacgggggttaaccgaagggtaccgggtaacgttaccgtaacgttccgttaaccgtttcggtaaccggg

SEQ ID NO: 332436 - DNA, 589 bp, Homo sapiens
  misc_feature: GZ8MTXP01CRO4T.8.34.D01.1.454.CMB.2.raw
  modified_base (325)..(325): a, c, t, g, unknown or other
  misc_feature (325)..(325): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
  modified_base (536)..(536): a, c, t, g, unknown or other
  misc_feature (536)..(536): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagccgtgggagtcacagagactctcgtgtgcagcctcgtgggttccaccttcagtaactacggcatgccacgtgggtcccaccaagctccgaggcaaggggnttgggagtgggtgctagttgttcatcgnggnggtcagtgttacaagtgtangcagtctcgtgacggcattcacatcncagagacaattcgaagaacactaagttgttattggacgctagaacagtaccctaaagtcccgtaggaacgaccggaacgggtccgttaaataccttagtacggtaacggaaacgggggttcggggaaaacccgngggtaaccgggtaacgttacccgaagtttaccgtcccgttaaggtaacccggg

SEQ ID NO: 332437 - DNA, 687 bp, Homo sapiens
  misc_feature: GZ8MTXP01AZRZN.8.34.D01.1.454.CMB.2.raw
  modified_base (315)..(315): a, c, t, g, unknown or other
  misc_feature (315)..(315): n is a, c, g, or t
  modified_base (634)..(634): a, c, t, g, unknown or other
  misc_feature (634)..(634): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggcctcccagtttcagataccaccggagagattgtgttgacacaatctccagccaccctgtcttcgtctccgaaggggaaagcgcccaccctctcctgcgacgggccagtcaagtatgttggcgacctacgtatccgtagtaccaacacgaaacctggcccaggccctaccgaccggtcccctanactctagtggtacgcacgtaccgaacgcgggccagtcggcaacgtcccgagcctaggttcaggtcgcaggggtgtagacgggtaaacagtaaccttcactctacacctatcgactcgacgtccgtagggactccgtaggaagtagttgtacggtcttaaacgtttattacgtacgtaccaacgttacgttaccggtaacgggtcggttcccgcccgggtaccccgggggtacttacccggtttcccggggacccgttacggggaaacctaaagggggcttaacgttaacgttaaacgtaaaaccggggtcttacggggngttacctaacgggtaccaaccggttacttcgttacgttcgttttccctaaccg

SEQ ID NO: 332438 - DNA, 685 bp, Homo sapiens
  misc_feature: GZ8MTXP01BKVIY.8.34.D01.1.454.CMB.2.raw
  modified_base (339)..(339): a, c, t, g, unknown or other
  misc_feature (339)..(339): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtggggaggtcacgagagactctcgtgtgcagcctcgtgggtcacctcagtaactacggcagtgacacgtcggggtcccaccaacgtcctacccgagggaccgaaagggggtntttacggggaggttgggggtggtcgtaggtttcgtttccagttcgtgggagggtctaggttgttacaagtgggtataggcctaggaccgttccgggtagggaacgggtccgtacttaccgacctactctacccgaagtaacgaacctaaacgttaccgaaacggtaaactaacgtaaggttagttagtttaggacgtaccgtagaacgacgtaccgttaacgtccgtaggacggacgaacggggtacttagtaacgttacgtagggtaacggaacgggggacgggggaaccaaggggtaccgggtaacgttacccgaaggttaccgttccggtttcggtaaccggg

SEQ ID NO: 332439 - DNA, 773 bp, Homo sapiens
  misc_feature: GZ8MTXP01DH3F9.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctccagtttcagataccacggagagattgtgttgacacaatctccagccacctgtcttcgctccgaaggggaaagacgccacctctctgcgagggccagtcaagaatgtggccgtacctacgtatccgtaggtaaccaaacgacgtaaacccgtcgggacccaacgggtccctaccccgacggtaccccctcaacgttcctaagttgggtacacctaactaccccaaacggacggggcccctaacggtcggaccaaccgttcccccgaaggtacccgttaggggttccaagggttccgggacgtaaggggttagggggtaactacgggggaaaacctaacggtaacctttacccaaccttacctaccaaaccctactcaaacttccgacgcccggtagggacctaccgtaggaaggttattggtttcgacttagtttaataccttaggtaacctaacgttaacggttccggtaaccggtaacgggtccggggtccccggttaccgggggtaccctaaccggtttcccgggacccggttaacgggaaacccgtaaaggtcgggaaattaaacgttaacgaaaaccgtacgttggttcggcctaaggacctaacgtacttcgttacgttccttaacgtaaccg

SEQ ID NO: 332440 - DNA, 764 bp, Homo sapiens
  misc_feature: GZ8MTXP01AQS2Y.8.34.D01.1.454.CMB.2.raw
tcagctcgcgtgtccacgaccggtgctcgatttagatcgtctgtgttggggtttgggggctctgggagaggagcccagcactagaagtcggcggtgtttccattcggtgatcagcactgaacacagaggactcaccatggagttgggctgaacttgggttttcctcgttgcttcttttaagaggtgtccagtgtcaagtgcaacgtggtggaggtcggtggggggaggcggtggtccaggccgtggggaggtccacgagagtactctcgtgtgcagcccttgtcgggttcctacctcgaacgtaacgtacggctagtcgccgtacgtcgggtcccgaccgaacgcctaccggagggaccgaaagggggtgtttgggagggtgggggtcggtacttaggtttgtttcaggttcgtggacgggtctagttgttactaagttgggtatggacgtagtaccgttaccgggtaggaaccgggggtcctaacgtttacccaaccgttacgtacccttaacccggacggaaactaaaccgtaaccgttaccgaaagggtaaacctaacgtaaaggggtttaggtttaacgtttacggggaacgttaccgtaacggtaaccaaaccgggttacccgttaaacggtcccggttaacggacggaaccggtaacgggttaacgttaaacgtaccgttacggtaaaggtaacggggaaggggacgggggacctaaggggacgtaacgtacgtacgttacgtcgttcgggtaaccgg

SEQ ID NO: 332441 - DNA, 769 bp, Homo sapiens
  misc_feature: GZ8MTXP01CIHZ2.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagccgtgggagtcacgagagactctcgtgtgcacgcctcgtggttcaccttcagtaactcggcatcgctacgtcgggtcccgaccaagcctacccgagggacgaagggggtagtttggggaggttgggggtcggcgttaggtttcgttttacccgagtttcggtaggggaacggggtcctaaagggttcgtttaacgtaaagttgggtaacttggaccgtacgggtaaccgttccgggtagggtaaaccgggtcccgtaagttcccgaacctacgttacccttacccgaaggaacgtaaacctaaacgttaaccgaacggtaaaccaacgtaaagtttacggtttaagtttacgggaagtccgttaacgaaccgtaacggtaccttaaacggtcccgtaagggaacggtaaccggtaacgggttacgttaaacttaaccggttaacgtacggggttaaacgggacgggggttaacgggggaacccgaggggtaaccgggtaacgttacccgttaaacgttccgttccggttaacggg

SEQ ID NO: 332442 - DNA, 654 bp, Homo sapiens
  misc_feature: GZ8MTXP01A2OEX.8.34.D01.1.454.CMB.2.raw
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaagacgccaccctctcctgcagggccagtcagaatgttggcgcctacgtatcctaggtaccaacacgaaacctggaccacggcctacccgacggcccctnactcctagtcggtnacactacccgaaacgacggggccaacgtcggaccaactccccgagccgtaggttcaggtcggacagggtgggatgggaacagtctcatcncactancatcacgctggacncgtgagtattgtacgacttagtttattactagtacgtaaactagtaccgtaacggtacggtaccgggcccggttaccgggggacccttaaccgggtttcccggacccggtacggggtaaacccgaaaggttgggaaacttaacgttaaccgtaaaaccggtaacgttggttcgggacctaaggaccctaaccgtacttccggttacgttcccgtttcgtaacccg

SEQ ID NO: 332443 - DNA, 679 bp, Homo sapiens
  misc_feature: GZ8MTXP01DESOO.8.34.D01.1.454.CMB.2.raw
  modified_base (298)..(298): a, c, t, g, unknown or other
  misc_feature (298)..(298): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagagtgtccagtgtcaagtgcaactggtggagtcgtgggggagcgtggtccagcctgggagtcacagagactctcgtgtgcagcctcgtgggttcaccttcaagtaactacggcatgcacgtcgggtccnccaagctccgaaggcgaagggtattgggagtggggtgctagtttgttcatcgtaggagggtctaggttgtacgtaaagtggttaatgacgaaaggtacgtccgggtagaaacggggtccgtacttccaccatcgtcaagaacactaacgttacgaacggtaaacaacgtaaactagttagtttacggacgtacgtacgaactaacgcctaacggtaacccgtgggaaggtaaccgagggtaccgttaagtaaccgttaacgtacggttaacggtaaacggggtaacgggggaaccgaacggggttaccggggtaacgttaacccggtaacgtttacccggtacccgttttacgggtaaccggttccgggtttaaccggggg

SEQ ID NO: 332444 - DNA, 736 bp, Homo sapiens
  misc_feature: GZ8MTXP01CH59E.8.34.D01.1.454.CMB.2.raw
  modified_base (173)..(173): a, c, t, g, unknown or other
  misc_feature (173)..(173): n is a, c, g, or t
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagnggtgtccagtgtcaagtgcaactggtggagtcgtgggggagcgtgggtccagcctggggaggtcacgagagactctcgtgtncagcctcgtggtcactcagtaactacggcatcgctacgtgggtcccncaacgctccgaggcaaggggattgggagtgggtggctaggtttgtttcagttcgtaggagggctagttacggttacaaggttggtaagtggacacgggtaccgtccgggtagggtaacggggtccgtacttaccgaacctacgttaccttacccgtaagaacgtaacctaaactttaccccgaaagggaaacctaaacccgtaaaggtttaaggtttaacgttttagggaacggtaccgtaacggtaaccgtaacggtacccgttaaacgttccgtacgggtaacgggaaccggtaaccgggggtacgttaacgttaaccgttacggttacgggaacgggttaaacgggggacggggggaaacccgtaacgggggtccggggtaacggtttacccgtaaacgggtttacctttaaccggtttcgggtaaccggg

SEQ ID NO: 332445 - DNA, 699 bp, Homo sapiens
  misc_feature: GZ8MTXP01CBITR.8.34.D01.1.454.CMB.2.raw
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagagtgtccagtgtcaagtgcaacgtggtggagtcgtgggggagcgtgtccagccgtgggagtcacagagactctcgtgtncagtcctgtggtcaccgtnaagtacacgcatcgctacgtcgggtcccacgaaacgccgtaccgagggtacgaaaggggtgttggggaggttcgggggtgtacgtaggttttcgttacgagttccgtggacgggtctaggttcgttacgaaaaggttgggttaatcggaaccgtacggtaccccgttaccggggtaggggaaaccggggtcccttagtttacccgaaccgtacttaccgtacccgaaggtaaaccgtaactaaagttaccccggaaagtaaaccaacgttaagttagtttaagggtttacggagtaacgtacggaaaccacgtactaacggtacctaggacgtacgacggtactaatacgttagtaggttacggaaaggggtacgggacgagggcggtaactaccgtaagttcccgtgttacgccgttcggtaaccggg

SEQ ID NO: 332446 - DNA, 517 bp, Homo sapiens
  misc_feature: GZ8MTXP02FXAXZ.8.34.D01.1.454.CMB.2.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtactacggcatgcactgggtccncaagctccaggcaagggnttgggagtgggtgcagttgttcatctgagggcagtgttcatggtatgcagactccgtgaaggcgattcacatctccagagacaattccagaacacaatgtatttggagctagaacagcctaaagtcctagagacacgggcgtatactactagtacgaaggagggggaaccaaggacggacgttccgaagtactcgtttgtacgg

SEQ ID NO: 332447 - DNA, 528 bp, Homo sapiens
  misc_feature: GZ8MTXP02F2N5J.8.34.D01.1.454.CMB.2.raw
  modified_base (297)..(297): a, c, t, g, unknown or other
  misc_feature (297)..(297): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccnccaagctccaggcaagggattgggagtggggtgcagttgttcatctgagggcagtgttcatggtatgcagactcgtgaaggcgatcacatctcagagacaatccagaacacaatgtattggagctagaacagcctaagtcctagacggacacgggacgtatactacgtggtaacggaagggacgggggaaccaaggacgggagttaccgaagtactaccgtttaggaccgg

SEQ ID NO: 332448 - DNA, 538 bp, Homo sapiens
  misc_feature: GZ8MTXP02HEA36.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtatcctggtaccaacagaaacctggccaggcctcccaggccccctcatctatggtgcatcccaaacagggccacgtggcactcccagccaggttcagtcggcagtgggtatgggacagcttcactctcaccatcatcagcctgagcctgaggatgttgctagtttattactgttacaactatacgtacgagtcggcccgtccgggggcctacgtttccggccgtggaaccgtaaagtcggatacgtacaaacgtaacgtgtaggctgcactactctcgtcttactac

SEQ ID NO: 332449 - DNA, 528 bp, Homo sapiens
  misc_feature: GZ8MTXP02GUW5T.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctccccaggccccctcatctatggtgcatccaacagggccactggcatcccagccaggttcagtcggcagtgggtatggggacagcttcactctcaccatcatcagcctggagcctgaggatgttgctagtttattactgtacaactatcgtaccgagtcggccgtccgggggcctacgtttcggcccgtgggaccaaaggtgatactacgaaacgactagtggctgcaccactctcgtcttctac

SEQ ID NO: 332450 - DNA, 545 bp, Homo sapiens
  misc_feature: GZ8MTXP02G8GRF.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgttggcgcctacgtatcctggtaccaacagaaacctggccaggcctccccaggccccctcatctatggtgcatccaaacacggggccacgtggccatccccagcccaggttcagtcggcaggtgggtatggggacagcttcactctcaccatcaatcagccctggacgcctgaggtatgttgctagtttatactgtacaactatacgtaccgagtcggccgtcgggggcctacgtttcggcccgtgggaccctaaaaggtcggatactacgaaacgacgtagtggactgcactatctcgttctctac

SEQ ID NO: 332451 - DNA, 550 bp, Homo sapiens
  misc_feature: GZ8MTXP02HCQGR.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgtggcgcctagtatcctggtaccaacagaaacctggccaggcctcccaggcccctcatctatggtgcatccaacaggggcccactggcatccccgagcccaggttcagtcggcaggtgggtatggggacagcttcactctcaccatcatcagcctggacgcctggaggatgttgctagtttattactgtacaactatcgtacgagtcggccgtccgggggcctacgtttccggcccgtaggggaccctaaaaggtcggatacgtacgaaaacgtacgtgtcggactcgacacactcgtcgttcttactac

SEQ ID NO: 332452 - DNA, 577 bp, Homo sapiens
  misc_feature: GZ8MTXP02IOXPQ.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtatcctggtaccaacagaaacctggccaggctcccaggccccctcatctatggtgcatcccaacgacggggcccaacgtggcactcccagccaggttcagtcggcagtgggtatgggacagcttcactctccaccatcatcagcctggacgcctgaggattgttgctagtttattacttgtacaactagttccgtaccggagtcggcccgtccgggggcctaccgtttccgggcccgtaggggaaccctaaacggtggaattactaccgaaaacggtacgtacggtcggactgacctaacctacttacgtcgttacctttctaccg

SEQ ID NO: 332453 - DNA, 521 bp, Homo sapiens
  misc_feature: GZ8MTXP02HBL01.8.34.D01.1.454.CMB.2.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (422)..(422): a, c, t, g, unknown or other
  misc_feature (422)..(422): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctctgggtcaccttcagtaactacggcatgcactgggtccnccaagctccaggcaagggnttgggagtgggtgctagttgtttcatcgtgagggcagtgttcagtggtatgcagactcgtgaggcattcacatctcagagacaatccagaacacaatgtattgganctagaacagacctaagtcctagaggacgacgggctatactacgcgtacggaagggagggggaacgaaggcggacgttacgaagtactacgttgtaccgg

SEQ ID NO: 332454 - DNA, 578 bp, Homo sapiens
  misc_feature: GZ8MTXP02HHS99.8.34.D01.1.454.CMB.2.raw
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggcctcccaggccccctnatctatggtncatccaaacgagggcccacgtggcactccccagccaggttcagtcggcaggtgggtatgggacagcttcactctcaccntccatcagcctggacgcctgaggatgtgctagtttattactgtacaactatacgtacgagtcggccgtccgggggcctaccgtttccggcccgtacgggaacccgtaaaaggtcggtaacgtactacgtaaaacgtaaccgtaggtcggactaacgaccaaccgtactccttacgttcctttacgtaccg

SEQ ID NO: 332455 - DNA, 558 bp, Homo sapiens
  misc_feature: GZ8MTXP02HR1EP.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagcccaccctgtcttcgtctccgaggggaaagagccaccctctcctgcagggccagtcagatgttggcgcctacgtatcctggtaccaacagaaacctggccaggcctccccgacggccccctcatcctagtggtgcatcccaaacgcggggcccacgtggcactccccagccaggttcaggtcggcaggtgggatggggacagccttcactctcaccatcatcagcctggacgcctgaggattggttgcttagtttattacttgtacaactatacggtaccgagtcggccgtccgggggcctacgtttccggcccgtagggaaccgaaggtaggatacgtacaaacgacgtgtggctcgcactactctcgtcttctac

SEQ ID NO: 332456 - DNA, 560 bp, Homo sapiens
  misc_feature: GZ8MTXP02F0UBN.8.34.D01.1.454.CMB.2.raw
  modified_base (208)..(208): a, c, t, g, unknown or other
  misc_feature (208)..(208): n is a, c, g, or t
  modified_base (295)..(295): a, c, t, g, unknown or other
  misc_feature (295)..(295): n is a, c, g, or t
  modified_base (400)..(400): a, c, t, g, unknown or other
  misc_feature (400)..(400): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagatgtggcgcctagtatcctggtaccaacagaaacctggccaggcctcccaggccccctnatctatggtgcatcccaacgaggggccacgtggcactcccagccaggttcagtcggcaggtgggtatgggacagccttcactctcacctatcatcagcctggacncctgaggtatgttgctagtttattactgtacaactagtcgtaccgagtccggccgtccgggggcctacgttccggcccgtaggggaaccctaaaggtcggaatacgtacgaaaacgtaccgtgtcggctcgaccaacctacttcgtcgttacttctaccg

SEQ ID NO: 332457 - DNA, 566 bp, Homo sapiens
  misc_feature: GZ8MTXP02GUEBQ.8.34.D01.1.454.CMB.2.raw
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttgcgccttcgtaagctggtaccaacacaaacctggccaggcctcccaggcccctnatctatggtncatccaacgagggccacgtggccatccccagccaggttcaggtcgcagtgggatggggacagcttcactctacaccatcatcagccctggacgccgtagaagatgttgctagtttattactgtacaactagtacgtacgagtcggccgtccgggggcctaccgtttccgggcccgtcggggaacccgtagggtacggaacgtactaccgaaaacggtaaccgtggtacggctggccaacctactcgtcgttcttactaccg

SEQ ID NO: 332458 - DNA, 549 bp, Homo sapiens
  misc_feature: GZ8MTXP02HMIIM.8.34.D01.1.454.CMB.2.raw
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacagagactctcgtgtgcagcctctgggttcaccttcagtaactacggcatgcactgggtcccnccaagcctccaggcaaggggnttgggagtggggtgctagttgttcatctgagggctagtgttcagtgggtatgcagactccggtagaacgggccgattcacatctccagagacaataccagaacacaatagttattggagtactgaacagacctaagtcctagaggacgacgggacgtatacgtacgtagtaacggagggaacgggggaacgaaggcgggacgtaccgaagtactacgtttacgtacgg

SEQ ID NO: 332459 - DNA, 572 bp, Homo sapiens
  misc_feature: GZ8MTXP02J3CLP.8.34.D01.1.454.CMB.2.raw
  modified_base (319)..(319): a, c, t, g, unknown or other
  misc_feature (319)..(319): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagtctgggaggtcacagagactctcgtgtgcagcctctgggttcaccttcagtaactacggcatgcactgggtcccgccaagctccaggcgaaagggnttgggagtggggtggctaggttgtttcatctgaggggcagtgttcagtggtatgcagactcggtgaaggccgatcacatcncanagacaataccagaacacaatgtattggagactgaacagaccgtaacgtccgtagaacggacgacgggacgtactacgtaactacggtacggaaacggggtacggggggaaacccgaaggggaccggggtaacgttacccgaaacggtaccttaccgtttacggtaccgg

SEQ ID NO: 332460 - DNA, 579 bp, Homo sapiens
  misc_feature: GZ8MTXP02HFGE7.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgtggcgctacgtatcctggtaccaacagaaacctggccaggcctcccaggccccctcatctatggtgcatccaacgagggccacgtggccatcccagcccaggttcagtcggctaggtgggtatggggacagacctttcactcctacaccatccatcagccctggacgcctgagatgtgtctagtttatactgtacaactagtccgtacgagttcggcccgtccgggggcctacgtttccggacccgtcgggaaccctaaaaggtcgggtaatacgtaccgaaaacggtaccgtaggtcggacctggacctacccgattccctggttacctttacgtacc

SEQ ID NO: 332461 - DNA, 540 bp, Homo sapiens
  misc_feature: GZ8MTXP02G77K0.8.34.D01.1.454.CMB.2.raw
  modified_base (208)..(208): a, c, t, g, unknown or other
  misc_feature (208)..(208): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagatgtggcgcctacgtatcctggtaccaacagaaacctggccaggcctcccaggccccctcatctatggtgcatccaacagggccactggccatccccagccaggttcagtcggcaggtgggtatggggacagtccttcactctcaccatcatcagcctggagcctgaggtatgttgactagtttattactgtacaactatcgtaccgagtcggcccgtccgggggcctacgttccggcccgttggacccgtaaaggtcggatacgtacgaaacgtacgtgtacgctgcaccatctcgtctctac

SEQ ID NO: 332462 - DNA, 573 bp, Homo sapiens
  misc_feature: GZ8MTXP02INWOL.8.34.D01.1.454.CMB.2.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagccgtgggagtcacagagactctcgtgtgcagcctctgggttcaccttcagtaactacggcatgcacgtgggtccnccaagcctccaggcaagggnttggagtgggtgctagttgttccatctgagggcagttgtcaatggtatgcagctcgtgaggcgatcacatctccagacgacaactccaagaacacaatgttagtttggacgtcgtagaactagaccgtaacgtaccgtaggaacggacgacgggtacgtaacttaacgtacgtacggtaacgggaaggggaacgggggaaaccgacgggacggggtacgttaccgaacgttaccgttacgtttacgg

SEQ ID NO: 332463 - DNA, 534 bp, Homo sapiens
  misc_feature: GZ8MTXP02GYA58.8.34.D01.1.454.CMB.2.raw
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctnatctatggtncatccaacaggccactggcatcccagccaggttcagtcggcagtgggatggggacagcttcactctcaccatcatcagcctggagcctgagatgttgctagtttattactgtacaaactatcgtaccgagtcggccgtccgggggcctacgtttccggcccgtgggaacccaaagtcggaatactacaaacgaactgtacggctcgcaaccatcctgtccttactacc

SEQ ID NO: 332464 - DNA, 577 bp, Homo sapiens
  misc_feature: GZ8MTXP02IQMJ9.8.34.D01.1.454.CMB.2.raw
  modified_base (426)..(426): a, c, t, g, unknown or other
  misc_feature (426)..(426): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccaggggaaagagccaccctctcctgcagggccagtcagatgttggcgcctacgtatcctggtaccaacagaaacctggccaggctcccacggccccctcatctatggtgcatcccaaacgacggggcccaacgtcggccaactccccagccctagggttcaggtggcaggtggggtatggggacagcttcactctaccaccatcatcagccctggacgcctgaggtntgttgctagtttattactgtacaactacttacgtacgaggtcggccgtccgggggctacgtttccggcccgtcgggaacctaaaggtcggaatacgtaacgaaacgtactacggtcggacgtaacgccgaacctactcgtacgttctctac

SEQ ID NO: 332465 - DNA, 548 bp, Homo sapiens
  misc_feature: GZ8MTXP02GBPPO.8.34.D01.1.454.CMB.2.raw
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgttggcgcctacgtatcctggtaccaacagaaacctggccaggcctcccaggcccctcatctanggtncatccaacagggccactggcactcccagccaggttcagtcgcagtgggtatgggacagcttcactctccaccatcatcacgcctggacgcctgacgagtgttcgcgtagtttattacgtgtactaactatcgtaccgagtcggccgtccggggcctacgtttccggccgtcgggaccgtaagtcggatacgtacgaaacgtacgtacggtcgacgtcgacactactcgtacgtccttctac

SEQ ID NO: 332466 - DNA, 552 bp, Homo sapiens
  misc_feature: GZ8MTXP02JDQ2M.8.34.D01.1.454.CMB.2.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctctgggttcaccttcagtaactacggcatgcactgggtcccncaagctccaggcaagggnttggagtgggtgctagttgttcatcgtgaggcaggtgttacagtggtatgacagactcgtagaggccgatcaccntcncaganacatcagaacacaatgtattggagtctagaacacgacgtaagtccgtaggacggaacgacgggacgtataacgtacgtacggtacggaaaggggacgggggaaaccaagggacggtacggttaccgaaggtaccgttaccgttagtaccggg

SEQ ID NO: 332467 - DNA, 567 bp, Homo sapiens
  misc_feature: GZ8MTXP02J0Q6K.8.34.D01.1.454.CMB.2.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccnccaagctccaggcaagggntggagtgggngcagttgttcatctgagggcagtgttcatggtatgcagactcgtgaggcgatcacatctcagagacaattccagacacaatgtattaggagtactagaacgacgaccgtaagtccgtagacggacgacgggacgtataaccgtacgtacggtaacggaaacgggggaacgggggaaaccgaaggggtacggggtaacgttaccgtaaacggttacccgttaccggtttacggtaacccggg

SEQ ID NO: 332468 - DNA, 581 bp, Homo sapiens
  misc_feature: GZ8MTXP02H2KF3.8.34.D01.1.454.CMB.2.raw
  modified_base (390)..(390): a, c, t, g, unknown or other
  misc_feature (390)..(390): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgtgcgctagtatcctggtaccaacagaaacctggccaggcctcccaggcccctcatctatggtgcatcccaaacgaggggcccacgtggaccactcccagccctagggttcaggtcggctaggtgggtatggggacagcttcactctcaccntcatcagcctggacgcctgaggtatgttgactagtttattactgtacaactagtacgtacgagtcggccgtccgggggtcctacgtttccggcccgtagggaacccgtaaaggtcggtaataacgtaacgaaaacggtacgtacggtacggactaacggacctaacgtacttcgtacgttctttactaccg

SEQ ID NO: 332469 - DNA, 595 bp, Homo sapiens
  misc_feature: GZ8MTXP02JMXCS.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgctacgtatcctggtaccaacagaaacctggccaggctcccaggccccctcatctatggtgcatcccaacaggggccacgtggcatccccagcccaggttcagtcggcaggtgggtatggggacagcttcactctacaccatcatcagccctggacgcctgagagtgtgctagtttattactgtacaactatacgtacgtagtcggcccgtcccgggggtcctacggtttcccgggcccgttacggggaaccctaaaaggtcgggtaactaacgtaaccgaaaacggtaacgtacggtacggccgtaacggccgaacctacgttaccttcggttaccttcgttaacccg

SEQ ID NO: 332470 - DNA, 590 bp, Homo sapiens
  misc_feature: GZ8MTXP02HQ1KA.8.34.D01.1.454.CMB.2.raw
  modified_base (294)..(294): a, c, t, g, unknown or other
  misc_feature (294)..(294): n is a, c, g, or t
  modified_base (379)..(379): a, c, t, g, unknown or other
  misc_feature (379)..(379): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccaggggaaagagccaccctctcctgcagggccagtcagaatgttggcgcctagtatcctggtacaacagaacctggccaggctcccaggcccctnatctatggtgcatcccaaacgagggcccactggcatcccagccaggttcaggtcggctaggtggtaatgggacagcttcacttcncaccatcatcagccctaggacgcctggaggtattgtttagcttaagtttattacgttgtactaactagttaccgtaccggaggtcggcccggtaccggggcctaccgtttccggacccgtagggaaccctaaaaggtcgaaacgttactaaaccgaaaacggtactacggtacggactaacgcaaccgtactcgtacgttctttacctacc

SEQ ID NO: 332471 - DNA, 543 bp, Homo sapiens
  misc_feature: GZ8MTXP02G5QM1.8.34.D01.1.454.CMB.2.raw
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggagtcacagagactctcgtgtgcagcctctgggttcaccttcagtaactacggcatgcacgtcgggtccnccaagctccgaggcaagggnttgggagtggggngcagttgttcatctggaggcagtgttcaatggtatgcagactcggngacggcgatcacntctcagacgacaattaccaggaacaacaatagtagtttagagtctagaacagacctaagtccgtagaggacgacgggacgtatactacgtaggtaacggaaggggacgggggaaccaggcgggacgttaccgaacgtacgtaccgttgacgtcgg

SEQ ID NO: 332472 - DNA, 572 bp, Homo sapiens
  misc_feature: GZ8MTXP02G58OY.8.34.D01.1.454.CMB.2.raw
  modified_base (315)..(315): a, c, t, g, unknown or other
  misc_feature (315)..(315): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtacaacagaaacctggccagctcccacggcccctcatctatggtgcatccaacgngggccactggccactcccagccaggttcagtcggcagtgggatgggacagcttcactcctacaccatcactcacgccgtggacgccgtggaggtactgttcgactagtttattacgtgtacaactagtacgtacgtaggtcggcccgtccgggggcctacggttccggaccgtacggggacctaaaggtcggaactacgtacgaaaacgtacgtacggtcggactaacgcaaccgtacgtcttacgtccttactacc

SEQ ID NO: 332473 - DNA, 574 bp, Homo sapiens
  misc_feature: GZ8MTXP02GJ409.8.34.D01.1.454.CMB.2.raw
  modified_base (298)..(298): a, c, t, g, unknown or other
  misc_feature (298)..(298): n is a, c, g, or t
  modified_base (445)..(445): a, c, t, g, unknown or other
  misc_feature (445)..(445): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgcacgtgggtcccnccaagctccgaggcaagggattgggagtgggtggctagttgttcatctgagggcagtgttcaagttggtatgcagtaccgtccgtaggaaacggggccgtattcaccatctaccagagacaataccaagaacacaatgtatttgganctagaacagacctaagtccgtaggagacgacggtcgtaactacgtacgtcggtaacggaagggacgggggaaccagggacgggaacgttaccgaacgttacgtaccgtttacggacgttacgtacgggg

SEQ ID NO: 332474 - DNA, 549 bp, Homo sapiens
  misc_feature: GZ8MTXP02IULI7.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccagggggaaagagccaccctctcctgcagggccagtcagatgtggcgcctagtatcctggtaccaacagaaacctggccaggctcccaggcccctcatctatggtgcatccaacgagggccactggcatccccagccaggttcagtcggcagtgggtatggggacagcttcactctccaccatcatcagcctggacgccgtgaggatgttgactagtttattactgtacaactatccgtacgagtcggccgtccgggggcctacgtttccggcccgtagggacccgtaaaaggtcggaactacgtacgaaacgtacgtacgtggcgtgacactactcgtcgtcttactac

SEQ ID NO: 332475 - DNA, 529 bp, Homo sapiens
  misc_feature: GZ8MTXP02F2KOR.8.34.D01.1.454.CMB.2.raw
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggagtcacagagactctcgtgtgcagcctctggtcacttcagtaactacggcatgcactgggtccncaagctccaggcaagggnttgggagtggggtgcagtttgttcatcgtgagggcagtgttcagtggtatgcagactcgtgaaggcgatcacatctcagagacatccagaacacaatgtattggatctagaacagactaagtccgtagacggacacggacgtatacgtacgtagtacggaagggacgggggaacaaggacgggtacgttaccggaagtaccgttaccgttaggtaccgg

SEQ ID NO: 332476 - DNA, 562 bp, Homo sapiens
  misc_feature: GZ8MTXP02HYXLR.8.34.D01.1.454.CMB.2.raw
  modified_base (209)..(209): a, c, t, g, unknown or other
  misc_feature (209)..(209): n is a, c, g, or t
  modified_base (521)..(521): a, c, t, g, unknown or other
  misc_feature (521)..(521): n is a, c, g, or t
  modified_base (535)..(535): a, c, t, g, unknown or other
  misc_feature (535)..(535): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccaccctctcctgcagggccagtcagaatgtgcgctacgtatcctggtaccaacagaacctggccaggctccccaggccccctcatctatggtgcatcccaaacaggggcccaacgtggacactccccgagccctaaggttccaaggtcggactaggtggggtatggggacaggtacctttcaactcctcaacccataccatcagccctgggacgccgtgaggtatcggttagcgtagtttatacttgtacaacgtatacgtaccgagtcggccgtcggggcctacgttcgccgtgggactaacgtcganactacgaactacgngtacgctgacacactctcgtctttcac

SEQ ID NO: 332477 - DNA, 542 bp, Homo sapiens
  misc_feature: GZ8MTXP02ITHM7.8.34.D01.1.454.CMB.2.raw
  modified_base (247)..(247): a, c, t, g, unknown or other
  misc_feature (247)..(247): n is a, c, g, or t
  modified_base (496)..(496): a, c, t, g, unknown or other
  misc_feature (496)..(496): n is a, c, g, or t
  modified_base (517)..(517): a, c, t, g, unknown or other
  misc_feature (517)..(517): n is a, c, g, or t
  modified_base (530)..(530): a, c, t, g, unknown or other
  misc_feature (530)..(530): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcaggccagtcagaatgttggcnctagtatcctggtaccaacagaaacctggccaggctcccaggcccctcatctatggtgcatccaaacgacggggccacgtggccagtcccagccaggttcaggtcggcagtgggtatggggaacaggacttcactctacaccatcatcacgcctggagcctgaggagttgttcgactagtttattactgtacaatatcgtacgagtcggccgtaccggggcctacgttccggccgtggaccgtaaaggngatacgtacaaacgacgtcgngactgacactacnctcgtctactac

SEQ ID NO: 332478 - DNA, 556 bp, Homo sapiens
  misc_feature: GZ8MTXP02HP0Y6.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccaggggaaagagccaccctctcctgcagggccagtcagaatgttggcgcctacgtatcctggtaccaacagaaacctggccaggcctcccacggccccctcatctatggtgcatccaaacgagggcccacgtggcactcccagcctaggttcaggtcggacaggtgggtagtgggacaggtcttcactctcacatcatcacgctggagcctgacgatgtgactagtttattactgtacaactatcgtacgagtcggcccgtccgggggcctacgttccggccgtacgggaaccgaacggtaggatactacgaaacgactggtacggcgtcgacaccgtactcgtcgtctttactacc

SEQ ID NO: 332479 - DNA, 650 bp, Homo sapiens
  misc_feature: GZ8MTXP02IU8P0.8.34.D01.1.454.CMB.2.raw
  modified_base (211)..(211): a, c, t, g, unknown or other
  misc_feature (211)..(211): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagngccaccctctcctgcagggccagtcagatgttggcgcctacgtatcctggtaccaacagaaacctggccaggcctcccacggccccctnatctatggtncactccaacgagggcccacgtggcactcccagccaggttcagtggcaggtgggtatggggacagcttcactctcaccatcatcagccctggacgcctaggaggtattcggttgaccttagttttattacgttgtacctaaacgtacgttaccggtaaccggaggttccgggaccccggttcccggggggacccttaccggttttcccgggaccccgttacgggggaaaccccgtaaaagggtcgggtaaacttaacgtaaaccgtaaaacggtaccgttagggttacggacttaacggaccaaaccgtacttaccgttcggtttacctttaccgttaccg

SEQ ID NO: 332480 - DNA, 530 bp, Homo sapiens
  misc_feature: GZ8MTXP02GCSLB.8.34.D01.1.454.CMB.2.raw
  modified_base (394)..(394): a, c, t, g, unknown or other
  misc_feature (394)..(394): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctccccaggccccctcatctatggtgcatccaacagggccactggcatccccagccaggttcagtggcagtggtatgggacagctcactctcaccatcatcagccctggacncctgaggattgttagcagttattactgtcacatcgtaccgagtcggccgtccggggccgtacgttccggtccgtcgggaccgaaacgtaggagtatacaaacgaacgtagtcggcgtcgcacactctctcttctac

SEQ ID NO: 332481 - DNA, 540 bp, Homo sapiens
  misc_feature: GZ8MTXP02FUJRB.8.34.D01.1.454.CMB.2.raw
  modified_base (296)..(296): a, c, t, g, unknown or other
  misc_feature (296)..(296): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccnccaagctccaggcaagggattggagtgggtgctagttgttcatctgagggcagtgttcaatggtatgcagactcgtgaagggccatcacatctccagagacaatccagaacacaatgtattggagctagaacagctaagtcctagaggacgacgggcgtaatactactagtaacgaaacgggacgggggaaccgaggacggggaacgttaccgaacgtacgtaccgtttagacgtcgtacgggg

SEQ ID NO: 332482 - DNA, 557 bp, Homo sapiens
  misc_feature: GZ8MTXP02GU08H.8.34.D01.1.454.CMB.2.raw
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgttggcgcctacgtatcctggtaccaacagaaacctggccaggctcccaggcccctnatctatggtgcatcccaaacnggggcccacgtggcactcccagccaggttcaggtcggcaggtgggtatggggacagcttcacttctcaccatcatcagcctggacgcctgaggatgttgctagtttattacgtgtacaactatcgtaccgtagtcggccgtccgggggcctacgttcgaccgtccgtacggaacgtaaggtacgacgtacaacgaacgtacgtaggtcgtaacgtcgacctacgtctcgtcgttcctttac

SEQ ID NO: 332483 - DNA, 531 bp, Homo sapiens
  misc_feature: GZ8MTXP02JNM0W.8.34.D01.1.454.CMB.2.raw
  modified_base (298)..(298): a, c, t, g, unknown or other
  misc_feature (298)..(298): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccaggcctgggaggtcacagagactctcgtgtgcagcctctgggttcaccttcagtaactacggcatgcactgggccncaagctccaggcaaggggattgggagtggggtgctagttgttcatcgtgagggcagtgttcagtggtatgcagactcgngaaggcattcacatcncagagacatccagaacacaatgtattggagactagaacagacctaagtccgtagaggacacgggcgtatacgtactacggtaacgaagggagggggaaccaaggacgggacgtaccgaagtaccgtacgtttaggacg

SEQ ID NO: 332484 - DNA, 559 bp, Homo sapiens
  misc_feature: GZ8MTXP02H15CR.8.34.D01.1.454.CMB.2.raw
  modified_base (171)..(171): a, c, t, g, unknown or other
  misc_feature (171)..(171): n is a, c, g, or t
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtggtccagcctgggagtcacagagactctcgtgtgcagccctntgggttcaccttcagtaactacggcatgcactgggtccgccaagctccgaggcaagggnttgggagtgggtggcagttgttcatctgagggcagtgttcaagttggtatggcagactccgtgaagggccgattcacatctcagagacatccagacanaatgtattgganctagaacagactaagtcctaggaacggacgacgggacgtataccgtacgtacgtaacggaaaggggaacgggggaaccaaggacggggtaacgttaccgaaagttcctaccgtttacggtacgtacgtcgggg

SEQ ID NO: 332485 - DNA, 558 bp, Homo sapiens
  misc_feature: GZ8MTXP02HWH7F.8.34.D01.1.454.CMB.2.raw
  modified_base (299)..(299): a, c, t, g, unknown or other
  misc_feature (299)..(299): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggaggtcacagagactctcgtgtgcagcctctggtcaccttcagtaactacggcatgcacgtgggtcccnccaagcctccgaggcaaggggatttgggagtgggtggctagttgtttcatcgtggaggctagtgttcagtggtatgcagactcgtagaggcgattcacatctcagagacaatcaagaacacaatgttattggagactagaacagtacgtaagtccgtagacggaacgacgggacgttaatacgtacgtagtacggaaacgggacgggggaaaccgaaggcgggaacgttaccgaagtaccgttacgtttacggtaccgg

SEQ ID NO: 332486 - DNA, 529 bp, Homo sapiens
  misc_feature: GZ8MTXP02FU4VQ.8.34.D01.1.454.CMB.2.raw
  modified_base (318)..(318): a, c, t, g, unknown or other
  misc_feature (318)..(318): n is a, c, g, or t
  modified_base (376)..(376): a, c, t, g, unknown or other
  misc_feature (376)..(376): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctctgggttcaccttcagtaactacggcatgcactgggtccgccaagctccgaggcaagggnttgggagtggggtgcagttgttcatctgagggcagtgttcagtggtatgcagactcgngaaggcgatcacatctcagagacaatcagaacacaatgtattggagctagaacagcctaagtcctagaggacgacgggcgtaatactacgtaggtacggaagggacgggggaaccgaaggacgggacgtaccgaacgtactccgttagtacgg

SEQ ID NO: 332487 - DNA, 531 bp, Homo sapiens
  misc_feature: GZ8MTXP02IYPS1.8.34.D01.1.454.CMB.2.raw
  modified_base (306)..(306): a, c, t, g, unknown or other
  misc_feature (306)..(306): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaagagccaccctctcctgcagggccagtcagaatgttggcgcctagtatcctggtaccaacagaaacctggccaggctcccaggccccctcatctatggtncatccaaacgagggccactggccatccccagccaggttcaggtcgcagtggtatgggacagcttcactctcaccatcatcagcctgagcctgaggatgttgctagtttattactgtacaactatacgtacgagtcggccgtccgggggcctacgttccggccgtggaacctaaaggtcggatacgtacaaacgacgtagtgctcgacactactctcgtcttctac

SEQ ID NO: 332488 - DNA, 585 bp, Homo sapiens
  misc_feature: GZ8MTXP02F2DVW.8.34.D01.1.454.CMB.2.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgtgcnctagtatcctgtaccaacagaaacctggcaggctcccaggcccctnatctatggtgcatcccaaacacggggccacgtggccactccccaagcctagggttccaggtcggacagggtggggtatggggacaggtccttcacttctaccaaccatccatcagccctggacgtccgtgaggattgttgctagtttattactgtacaactagtacgtacgagtcggccgtccgggggcctacgttccgaccgtaccggtacggaacgtaacggtagtacgtaacgtaaacgaaaccgtaacgtcggtacgtaacgtacgacctaactctacgtcgttacttacg

SEQ ID NO: 332489 - DNA, 555 bp, Homo sapiens
  misc_feature: GZ8MTXP02GQRVU.8.34.D01.1.454.CMB.2.raw
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctagtatcctggtaccaacagaaacctggccaggcctcccaggccccctcatctatggtncatcccaacgacgggcccacgtggccactccccagccaggttcagtcggcagtgggtatggggacagcttcactcncaccatcatcacgcctggagcctgacggatgttgctagtttattacttgtactaactagtacgtaccgtagtccgggcccgtccgggggacctaccgtttccggcccgtacgggaacctaaacggtggatacgtacgaaacgacgtagcgctgacacactctcgtcttctac

SEQ ID NO: 332490 - DNA, 566 bp, Homo sapiens
  misc_feature: GZ8MTXP02IO73X.8.34.D01.1.454.CMB.2.raw
  modified_base (308)..(308): a, c, t, g, unknown or other
  misc_feature (308)..(308): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtgggttcaccttcagtaactacggcatgcacgtgggtccnccaagcctccgaggcaaggggattggagtgggtgctagtttgttccatcgtggagggcagttgtcaatggtatgcagactcgngaggcgatcncatctcagagacatcagaacacaatgtattggagctagaacagtacctaagtccgtagacggacgacgggtacgtaactacgtacgtacggtaacggaaggggaacgggggaaaccgaacgggacgggggtaacgttaccgaaacgttaccttaccggtttacgg

SEQ ID NO: 332491 - DNA, 590 bp, Homo sapiens
  misc_feature: GZ8MTXP02IMP9M.8.34.D01.1.454.CMB.2.raw
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgagctctgggagaggagcccagcactagaagtcggcggtgtttccattcggtgatcagcaatgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtgggttcaccttcagtaactacggcatgcacgtgggtccnccaagcctccgaggcaagggnttgggagtgggtgctagttgttcatcgtggaggctaggttgttacagtggtatgcagactccgtaggacggcgattcaccatctacagacgacaatccaagaacacaatgttagttaggagactagaacagtacctaagtcctagaacggacgtacggggtacttaacgtacgtaacgtacggtaaccggaaagggggaacgggggaaaccgaagggaccggggtaacgtttacccgaaaaggttacccgttaccgtttacggacccggg

SEQ ID NO: 332492 - DNA, 528 bp, Homo sapiens
  misc_feature: GZ8MTXP02FSVS1.8.34.D01.1.454.CMB.2.raw
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (397)..(397): a, c, t, g, unknown or other
  misc_feature (397)..(397): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgtggcncctagtatcctgtaccaacagaaacctggccaggctcccaggcccctnatctatggtncatccaacagggccactggcactcccagcccaggttcagtgcagtgggtatgggacagcttcactctcaccatcatcagcctggacgcctgagntgttgctagtttattacgtgtacaactatcgtacgagtccggccgtccgggggcctacgttccggccgtgggaacctaaggtggatacgtacaaacgtactcggtgctgacaccgatcgtacgtcttctac

SEQ ID NO: 332493 - DNA, 657 bp, Homo sapiens
  misc_feature: GZ8MTXP02I9PU5.8.34.D01.1.454.CMB.2.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttggctgaacttgggttttcctcgttgcttcttttaagaggtgtccagtgtcaagtgcaactggtggagtcgtgggggagcgtggtccagccgtgggagtcacagagactctcgtgtgcagcctgtggtcacttcagtactacgcatgcacgtggcccncaagctccgaggcaagggnttgggaggtggggtgctaggtttgttcagttcgtggagggctaggttcgttacagtgggtaatcggacagtaccgtcggtaggaacgggccgtacgttaccaacctacgttcccgtacccgaaggaacgtaacctaaacgttaccgaaaggtaaaccaactaaagttagttagtttaggacgtactacgaaacgacgtaaccgtaacggtccgtaggaacgaaccgtaacgggtacttaacgtaaccgtacgtaagggtaaccgggaaaggggtaaccgggggaaaccgaagggaccgggtaacgttaaccgaaacgtttacccgttaccggttacggtaaccgg

SEQ ID NO: 332494 - DNA, 553 bp, Homo sapiens
  misc_feature: GZ8MTXP02J4JCX.8.34.D01.1.454.CMB.2.raw
  modified_base (269)..(269): a, c, t, g, unknown or other
  misc_feature (269)..(269): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
tcagctcgcgtgtccacgaccggtgctcgatttagatcgtctgtgttgggtctgggagaggagcccagcactagaagtcggcggtgtttccgttcggtgatcagcactgaacacagaggactcaccatggagtttgggctgaactgggttttcctcgttgctcttttaagaggtgtccagtgtcaagtgcaactggtgagtcgtgggggaggcgtggtccagcctgggagtcacagagactctcgtgtgcagcctctgggttcaccttnagtaactacggcatgcactgggtccgccaagctccaggcaaggggattggagtgggtggcagtttgtttcatctgaggggcagtgttcaatggtatgcagactccgtgaagggccgattcaccatctccagagacaattccaggaacacaatgtatttggnctgaacngcctaagtcctgagggacacggggcgtaatacactagtacggaaaggggacggggtacggacggacggtacggtaacttacgtacttaccgttcgttcggtacgtcggtaccgggg

SEQ ID NO: 332495 - DNA, 565 bp, Homo sapiens
  misc_feature: GZ8MTXP02G1QG6.8.34.D01.1.454.CMB.2.raw
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtggttcaccttcagtaacctacggcatgcacgtgggtccgccaaagcctccgaggcaaaggggattgggagtgggtgcagtttgttccatctgagggcagtgttcaaatggtaatgcagactccgtagaggccgatcacatcnccagagacaatcaagacaacaatgtattgganctagaacagacctaagtcccgtagacggacgacgggacgttaataacgtaactaggtaaccggaaggggaacgggggaaaccgaggacggggacgttacccgaaagtaccgtacgtttacgg

SEQ ID NO: 332496 - DNA, 542 bp, Homo sapiens
  misc_feature: GZ8MTXP02GEMNK.8.34.D01.1.454.CMB.2.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (382)..(382): a, c, t, g, unknown or other
  misc_feature (382)..(382): n is a, c, g, or t
  modified_base (453)..(453): a, c, t, g, unknown or other
  misc_feature (453)..(453): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagccctctgggttcaccttcagtaactacggcatgcacgtgggtccnccaagcctccaggcaaggggnttggagtggggtggcagtttgttcatcctgaggggctagtgttcaatgggtatggcagactcgngaacggcgattcacatctcagagacaattccagaacacaatgtatttggagctagaacagacctaagtccngaggacacgggctatactacgtagtaacggaacgggagggggaaccgaggaacgggtacgtaccgaacgtactacgtttcggacgtcgg

SEQ ID NO: 332497 - DNA, 614 bp, Homo sapiens
  misc_feature: GZ8MTXP02GGUII.8.34.D01.1.454.CMB.2.raw
  modified_base (297)..(297): a, c, t, g, unknown or other
  misc_feature (297)..(297): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtggttcaccttcagtaactacggcatgcacgtgggtccnccaagctccaggcaagggattgggagtgggtgctagttgttcatctgagggcaggttgttacaagttgggtatggctaaggtacctccgggtaggaaacgggcccgtattccaccctatacctccgaagagaacctaaagttacccaaaggaaacactaaattagttaatttaggagtcttaggaaacacgccttaaagtcctaggaggaacgacgggacgtaactaccttacgtacgtaacggaaagggacgggggaaaccgaggacgggaacgttaccgaacgttacctacgtttacggaccgttacgtacgggg

SEQ ID NO: 332498 - DNA, 547 bp, Homo sapiens
  misc_feature: GZ8MTXP02GMUO5.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgttggcgcctacgtatcctggtaccaacagaaacctggccaggcctcccaggccccctcatctatggtgcatccaacagggcccactggcactcccagccaggttcagtggcagtgggtatggggacagcttcactctcaccatcatcagcctggacgcctgagatgttgctagtttattactgtacaactatccgtaccgagtcggcccgtccgggggcctaccgtttccggcccgtcggggaccctaaaggtcggatacgtacaaacgacgtcgtacggctgccacctactctacgttccttctac

SEQ ID NO: 332499 - DNA, 508 bp, Homo sapiens
  misc_feature: GZ8MTXP02IMQ0T.8.34.D01.1.454.CMB.2.raw
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggagcgtggtccagcctgggaggtcacagagactctcgtgtgcagcctntgggttcaccttcagtaactacggcatgcactgggtccnccaagctccaggcaagggnttgggagtgggtgcagttgttcatcngaggcagtgttcagtgtatgcagctcgtgagcattcacntctacagagacaatcagaacacaatagtagttggagactagaacagctaacgtcctagagacacggctatactagacgtacgaaggacggggaacgaaggcggacgtacgaagtactcgttagtacgg

SEQ ID NO: 332500 - DNA, 637 bp, Homo sapiens
  misc_feature: GZ8MTXP02JL12X.8.34.D01.1.454.CMB.2.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcaagtaactacggcatgcacgtgggtccnccaagctccaggcaagggnttgggagtgggtgctagttgttcatcgtggaggctagtgttacagttgggtatggacagtacgtccgtaggaaacgggccgtaattccaacctatcctacccaggacgaactaacgttacccaaggaaaccaactaaagtaggttaatttagggaagtactacgaaacgacggtacctaaacggttcccgtaggaacgggaccgaacgggggtacttaaacgtacgtaacgtacggtaaaccgggaaaggggaacgggggaaaccaaggggacggggtaacgttaccggaaaagttaccgttaccgtttaggtaaccgg

SEQ ID NO: 332501 - DNA, 658 bp, Homo sapiens
  misc_feature: GZ8MTXP02HHXAE.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgtggcgcctacgtatcctggtaccaacagaaacctggccaggcctcccacggcccctcatctatggtgcatccaaacgacgggcccacgtggccactccccagccaggttcaggtcggcaggtgggtatgggacagcttcactctacacctatcatcacgccgtggacgccgtagtaggtagtggttgtcgttagtttattacgttacgttacctaaactacgttaccggtaccggtacggtccgggtacccggttcccggggggtacccttaaccggtttcccgggtacccccgggttacggggaaacccggtaaaacgggtacgggtaaacgttaaacgtaaccgaaaacggtaaaccgttagggtacggacgttaacggaccgtacctacgttcttcggttacctttacgtaccg

SEQ ID NO: 332502 - DNA, 546 bp, Homo sapiens
  misc_feature: GZ8MTXP02G3WX3.8.34.D01.1.454.CMB.2.raw
  modified_base (208)..(208): a, c, t, g, unknown or other
  misc_feature (208)..(208): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggccccctcatctatggtgcatccaacgagggccactggcatccccagccaggtcagtcggcagtgggtatggggacagcttcactctcaccatcaatcagccgtggacgcctgaggtatgttgactagtttattactgtacaactatcgtaccgagtcggcccgtccgggggcctacgtttccggcccgtagggaacccgtaaaggtggatacgtacgaaacgaacgtgtcggactgacaccactctactcttctac

SEQ ID NO: 332503 - DNA, 578 bp, Homo sapiens
  misc_feature: GZ8MTXP02HATPX.8.34.D01.1.454.CMB.2.raw
  modified_base (210)..(210): a, c, t, g, unknown or other
  misc_feature (210)..(210): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (557)..(557): a, c, t, g, unknown or other
  misc_feature (557)..(557): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccaccctctcctgcagggccagtcagatgtgcgctacgtatcctggtaccaacagaaacctggccaggcctcccgacggcccctcatctatggtncatccaacgngggccactggccatccccgagccaggttcagtcggcaggtggtatgggactagcttcactctaccaccatcatcagcctggacgccgtgaggattgttgcgttagtttattactgtacaactgttaccgtacggtagtcggtcccggtccgggggtaccctacggtttcccgggcccgtacggggaaccctaaaaggtcggtataacgtacgaaaacgtacgtcggtacgctggccaacncttacgtcgttacctctaccg

SEQ ID NO: 332504 - DNA, 559 bp, Homo sapiens
  misc_feature: GZ8MTXP02GERX2.8.34.D01.1.454.CMB.2.raw
  modified_base (297)..(297): a, c, t, g, unknown or other
  misc_feature (297)..(297): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctctgggttcaccttcagtaactacggcatgcactgggtccnccaagctccaggcaagggattggagtggggtgctagttgttcatctggaggggctaggtgttacaagttgggtatgcagacctccggtaggaaacgggccgattcaccatctcagagacaataccagaacacaatgtattggagctagaacacgacctaagtcgtagaggacgacgggacgtactacgtacgtacggtaacggaagggacgggggaaccgaggacgggaagtacgaacgtactcgttacgacgtcgtcgggg

SEQ ID NO: 332505 - DNA, 558 bp, Homo sapiens
  misc_feature: GZ8MTXP02IBWRZ.8.34.D01.1.454.CMB.2.raw
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (542)..(542): a, c, t, g, unknown or other
  misc_feature (542)..(542): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacacgaaacctgccaggctcccaggcccctnatctatgncatccaagaggccagtgcatccagccaggtcagtgcagtgggatgggacagcttcactctcaccntacatcacgtcctggacgccgtgacggatgttgacttagtttatactgtacaaantcggtaacgnggtcggcccggtccggggacctacggtttcccggacccgtaggggaaaccctaaacgggtaggtactaaactaccgaaaacgtacgtgtacggctaaggaccacctancgttctacttctaccg

SEQ ID NO: 332506 - DNA, 635 bp, Homo sapiens
  misc_feature: GZ8MTXP02IJAST.8.34.D01.1.454.CMB.2.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (394)..(394): a, c, t, g, unknown or other
  misc_feature (394)..(394): n is a, c, g, or t
  modified_base (429)..(429): a, c, t, g, unknown or other
  misc_feature (429)..(429): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgtgcgctacgtatctggtacaanagaacctggccaggcctcccaggcccctnatctatggtncactacccaacgacgggccacgtcggacactcccagcctaggttccaggtcggctagggtgggtatggggacagcttcactcctacaacctntaccactacgacgccgtggacgtccgtaggaagtnttggtacgtacgttagtttaacttacgtagttacctaaactacgttaccgaccgggtaggttccggaccccgggtccgggggtaccctacccggtttcccggaccccggttaaggggaaacccgtaacgggtagtaaacgtaacgttaaaccgaaaacgtacggtacgttcgacgtaacgcgaactacgtatccgtacttactccg

SEQ ID NO: 332507 - DNA, 605 bp, Homo sapiens
  misc_feature: GZ8MTXP02HTLNL.8.34.D01.1.454.CMB.2.raw
  modified_base (304)..(304): a, c, t, g, unknown or other
  misc_feature (304)..(304): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctctggtcaccttcagtaactacggcatgcacgtgggtcccnccaagcctaccgaggcaaggggntttgggaggtgggtgctagttgttcatcgtgagggctaggttgttacagttggtatgccagactcggtagaacggcgattcaccatctacgagtacgaactaacgtaccaagaaactaactaagttagtttaagttaggagtactaggaacacgacgtaacgtaccgtaggaacggacgacggtacgtaactacgttacgtaaggtacgggaaggggaacgggggaacgaacgggtacgggtacgttaccgaacgttaccgttaccgtttacgaccgg

SEQ ID NO: 332508 - DNA, 546 bp, Homo sapiens
  misc_feature: GZ8MTXP02GOY1Q.8.34.D01.1.454.CMB.2.raw
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (353)..(353): a, c, t, g, unknown or other
  misc_feature (353)..(353): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacagagactctcgtgtgcagcctntggttcaccttcagtaactacggcatgcacgtgggtccncaagctccaggcaagggnttgggagtgggtgcagttgtttcatcgnggaggggcaggtgttacagtggtatgcagactcgtgaaggcatcacatctcagagactaatacagaaacactaatgttattggagctagaacagactaagtcctagagacgacgggcgtatactacgtaggtaacgaagggacgggggaaccaaggacgggacgttaccgaagtaccgtcgtttaggtaccgg

SEQ ID NO: 332509 - DNA, 612 bp, Homo sapiens
  misc_feature: GZ8MTXP02HAAN2.8.34.D01.1.454.CMB.2.raw
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtggttcaccttcagtaactacggcatgcacgtgggtcccnccaagcctaccgaggcaaaggggtnttgggaggttggggtggctaggtttgtttcagttcgtggaggggctaggtgttcaagttgggtatgctggaccgccgtggaaacgggccgtattcacctattctccagacgaacaactacaagacacaatcgtattcggactagaacacgacctaagtcctaggacggacgacgggtagtactaacgtacgtaggtaaacgggaaggggacgggggaaccgagggacgggtaacgttaaccgaaacggttaccgttaccgtttaggaccggttacggtacggggtacccg

SEQ ID NO: 332510 - DNA, 561 bp, Homo sapiens
  misc_feature: GZ8MTXP02GNL84.8.34.D01.1.454.CMB.2.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggcctcccaggccccctnatctatggtncactcccaaacncggggccacgtggacactccccagccaggttccagtcggcagtgggtatggggacagtaccttcacttctacaccatcatcacgcctggagcctggagatgttgacttagttattactgtacaactatcgtaccgagtcggccgtaccgggggcctacgttccggccgtgggaacctaaaggtggatacgtacaaaacggtactacggtgactcgacaccgtactcttcgtcttactaccg

SEQ ID NO: 332511 - DNA, 592 bp, Homo sapiens
  misc_feature: GZ8MTXP02JJ6RR.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctctggttcaccttcagtaactacggcatgccacgtcgggtcccgccaagcctcccgaggcaaaggggattgggagtgggtgctagtttgttccagtctgagggcagttgttcaagtggtatgcagtactccgtagaacggccgattcaccatctaccagacgaacacttaccaaggtaacaactaagtgttagtttagggaatacgtaggaacacgtacctaaagtccgtagacggaacgacgggtacgtaactacgtacgtaggtaacggaagggaacgggggaaccgaggacggtacgtaccgaacgtaccgtacgtttacgg

SEQ ID NO: 332512 - DNA, 581 bp, Homo sapiens
  misc_feature: GZ8MTXP02HA4EZ.8.34.D01.1.454.CMB.2.raw
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgttggcgcctagtatcctggtaccaacagaaacctggccaggcctcccgaggcccctnatctatggtgctactaccaacgaggggccacgtggccactcccagcccaggttcaggtcggacnggtgggtatggggacagacttcaactctaccaccatcactcagtcccgtggacgtcctgaggtactggttgacgttagtttattacgttgtacaactatacgtacggacgtacggtccgtccgggggacctacgttccggaccgtacggggacctaaaaggtcggaatactacgaaacggtactcggtacggctcgaccacgtactcgtcgttctctacc

SEQ ID NO: 332513 - DNA, 582 bp, Homo sapiens
  misc_feature: GZ8MTXP02JAHJ1.8.34.D01.1.454.CMB.2.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctgtgtgcagcctntggttcaccttcagtaactacggcatgcacgtgggtccnccaagcctccgaggcaagggnttgggagtgggtgctagttgtttcagtctgaggctagtgttacagtgggtatgcagtactccggtaggaacgggctagttcactactcctaccagacgacaacttaccgagaaacacaaatgttatttggagtacgtagaacacgtacctaaagtccgtaggacgacgacgggctaataccgtacgtacggtaacggaacggggacgggggaaaccgaaggacggggtaacgttaccgaacgttaccgtaccgttacggtacccgg

SEQ ID NO: 332514 - DNA, 540 bp, Homo sapiens
  misc_feature: GZ8MTXP02GOFP6.8.34.D01.1.454.CMB.2.raw
  modified_base (303)..(303): a, c, t, g, unknown or other
  misc_feature (303)..(303): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgtggcgctagtatcctgtaccaacagaaacctggccaggctccccaggccccctcatctatggtncatccaacagggccacgtggcatcccagccaggttcagtcggcagtggggtatggggacagcttcactctcaccatcatcagcctggagcctgaggatgttgctagtttattactgtactaactatcgtaccgagtcggccgtccgggggcctacgtttccggccgtcgggacccaaaggtcggatactacgaaacgtaacgtcgtaggcgtaagcaccgactctacgtcttactac

SEQ ID NO: 332515 - DNA, 558 bp, Homo sapiens
  misc_feature: GZ8MTXP02HC23N.8.34.D01.1.454.CMB.2.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggtcaccttcagtaactacggcatgcactgggtccnccaagctccaggcaagggnttgggagtgggtggctagttgtttcatctgagggcaggtgttcagttggtatgcagactccggtagaagggccgattcgaccatctccagagacaatccagaacacaatgtattggagctagaacacgacctaagtcctagaggacgacgggcgtatacgtacgtacgtacgaacggggacgggggaaccgaaggacgggacggttaccgaacggtactaccgtttacgtaccgg

SEQ ID NO: 332516 - DNA, 560 bp, Homo sapiens
  misc_feature: GZ8MTXP02JQWAN.8.34.D01.1.454.CMB.2.raw
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtacaacagaaacctggccaggcctcccgacggccccctcatctatggtgcatccaacaggggccacttgcactcccagcccaggttcagtggcagtgggtatggggacagcttcactctccaccatcatcacgcctggacgccctgaggatgttgctagtttacttactgtacaatactcgtaccggagtcgggcccgtccgggggtccctacgtttccggcccgtacgggaccgtaaaaggtcggaactaacgtacaaacgtaacgtgtacggctgccaccatctacgtcttactacg

SEQ ID NO: 332517 - DNA, 717 bp, Homo sapiens
  misc_feature: GZ8MTXP02F4HWO.8.34.D01.1.454.CMB.2.raw
  modified_base (324)..(324): a, c, t, g, unknown or other
  misc_feature (324)..(324): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggttcaccttcagtaactacggcatcgcacgtcgggtcccgccaagcctccgaggacaaggggtnttgggaggtggggtggctaggtttgttcagtcgtggaggggctaggttgtttacaaattgggtatgactaaggtaccttccgggtaggaaacggggtcccgtaattccaacctactacctacccgaaagaacgtaacctaaacgttacccgaaaggtaaaccaaactaaagttacgttaagtttacgggaagtaccgttaaggaaaccaaccggtaccttaaacggtacccgttaaggaacgggaaccgtacggggtaaccgttaagttaaccgttaaccggtagggttaaaccgggaaaagggggaacggggggaaaacccgaggggaaccggggtaacgttaacccgtaaaggttaccgttaccgtttacggaccggttcggtaccggggg

SEQ ID NO: 332518 - DNA, 655 bp, Homo sapiens
  misc_feature: GZ8MTXP02GCA20.8.34.D01.1.454.CMB.2.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (257)..(258): a, c, t, g, unknown or other
  misc_feature (257)..(258): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (275)..(276): a, c, t, g, unknown or other
  misc_feature (275)..(276): n is a, c, g, or t
  modified_base (278)..(279): a, c, t, g, unknown or other
  misc_feature (278)..(279): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (292)..(293): a, c, t, g, unknown or other
  misc_feature (292)..(293): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagacgccaccctctcctgcagggccagtcagatgtgcnctagtnctgacannaacngcagcncagcccnntnngncacncagngcnngcacnccagctagtcngtcgcaggtggtagnggacagtctcactcacacatcactcgacgtccgtaggacgtccgtaggaggtacttggtacgtacgtttagtttacttacgttacgtaacctaaacgtacgttacccggtaccgggtacggttcccggggtaccccgggttacccgggggtaccctttacccggggtttcccgggtacccgggtaaccgggggtaaaacccgtaaaaggggttcgggtaaacttaaaccggttaaaaccggaaaaaccggttaccggttaggggtaccggtaccgtaaccggtaccctaaaccgttacgtttccgtttacgtttaccctttaccgtaaccg

SEQ ID NO: 332519 - DNA, 635 bp, Homo sapiens
  misc_feature: GZ8MTXP02H88EE.8.34.D01.1.454.CMB.2.raw
  modified_base (208)..(208): a, c, t, g, unknown or other
  misc_feature (208)..(208): n is a, c, g, or t
  modified_base (301)..(301): a, c, t, g, unknown or other
  misc_feature (301)..(301): n is a, c, g, or t
  modified_base (429)..(429): a, c, t, g, unknown or other
  misc_feature (429)..(429): n is a, c, g, or t
tcagctcgcgtgtccacgaccggtgctcgatttagatcgtctgtgttgggtttgggaggaactgctcagttaggacccagagggaaccatggaagccccagctcagcttctcttcctcctgctactctggctcccagtttcagataccaccggagagattgtgttgacacaatctccagccaccctgtcttcgtctccagggggaaanacgccaccctctcctgcagggccagtcagaatgttggcgctacgtatcctcggtaccaacagaacctggaccaggcctccccacggccccctnactctatggtgcatcccaacgaggggccaacgtggccactcccagccctaggttccaggtcggactaggtggggtatggggaacaggtaccttccaactctaccacccatcactccagccctgggacnccgtgaggtattggttgcttagttttatacgttcgttacaactagttacggtaaccgtagggttcggcccggtcccgggggtacctaccggttttcccgggacccgttacggggaaccctaaaggttacgggaacttacgtaaccgtaaaacggaactcggttacggcttaacggaccaccgtatccgttcgttcctttactaccg

SEQ ID NO: 332520 - DNA, 557 bp, Homo sapiens
  misc_feature: GZ8MTXP02I4G4M.8.34.D01.1.454.CMB.2.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccncaagctcaggcaagggnttggagtgggtgctagttgttcatctgagggcagtgttcagtggtatgcagactcgtgaaggcgatcacatctcagagacaatcagaacacaatgtattggagactagaacagtaccgtaaagtccgtagacggacgtacggggactacgtaacgtaacgtacggtaacggaaacggggaacgggggaaaccgaacgggacgggtacggttaccgaaggttaccgttaccgtttacggtaccgg

SEQ ID NO: 332521 - DNA, 705 bp, Homo sapiens
  misc_feature: GZ8MTXP02IE4D5.8.34.D01.1.454.CMB.2.raw
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccacggagagattgtgttgacacaatctccagccaccctgtcttcgtctccgaggggaaagagccaccctctcctgcagggccagtcagatgtgcgctacgatcctgtacaanagaactgccagctcccgagcccctnatctagtggtncatcccgaaacgacggggcctaacgtgggacactccccgagccctagggttcaaggtcggacagggtcgggatggggacaggtcttcactctacaccatcatactagccgtggacgtaccgtaggacggtagttgttacgtacgttaagttttactttacgttacgttacctaaacgttacgttacccggttaaccgggtagggttccggggtaccccgggttacccggggggtcccttaacccgggtttttcccggggacccccgggtttacgggggaaaacccccgtaaaaggggttaccgggtaaattaaaccgttaaaccggaaaaccggttaaacgttcggggttaacgccgttaacggaccctaaccgtacttaccgtttcggtttacctttccgtaacccg

SEQ ID NO: 332522 - DNA, 659 bp, Homo sapiens
  misc_feature: GZ8MTXP02IEBFX.8.34.D01.1.454.CMB.2.raw
  modified_base (272)..(272): a, c, t, g, unknown or other
  misc_feature (272)..(272): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtggtccagcctgggaggtcacagagactctcgtgtgcagcctcgtggtcaccttnagtaactacggcatgcacgtcgggtcccaccaagcctcccgaggcgaaaggggtnttgggaggttggggtggctaggtttgtttcagttcgtaggagggctaggtgttacagttgggtatgacagactaccggtagaacgggtccgattccacctacgtcctaccgagaagacaaacttacccgaagaaaccactaaagttgtttaagtttagggacgtacgtacggaaactacgtaccgtaaacgtcccgtagggaacggaaccggtacggggtacgttaagtaccttaaacgtagggtaaacgggaaacgggggaacgggggaaacccgaagggtaccggggtaacgttacccggaaagttaccgttaccgtttacggacccggg

SEQ ID NO: 332523 - DNA, 723 bp, Homo sapiens
  misc_feature: GZ8MTXP02HFS7R.8.34.D01.1.454.CMB.2.raw
  modified_base (325)..(325): a, c, t, g, unknown or other
  misc_feature (325)..(325): n is a, c, g, or t
  modified_base (395)..(395): a, c, t, g, unknown or other
  misc_feature (395)..(395): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctcgtgtgcagcctcgtggttcaccttcagtaactcggcatcgcacgtcgggcccacaacgcctaccgaggacgaaggggtnttgggaggtggggtggcttaggtttcgtttacagttcgtggacgggtctagttggttacaaggttgggtntgactacggtaccgtccgggtagggaacgggtccgtaacttccgaacctactcctaccgaagaacgaactaaacgttccgaaaggaaacaacgtaaagttgtttaagtttacgggaacgtacgttaacgaaacgtaccggtaaccgttaaacggtacccgtagggaacgggtaacccgtacggggtaaccttaaacgtaaccgttaacggtacggggtaaaaccggggaaagggggaaccgggggaaacccgtaggggtaaccggggtaaccgttaccgaaacggtttaccgttaccgtttacgggaaccggtttccggtaccggggg

SEQ ID NO: 332524 - DNA, 562 bp, Homo sapiens
  misc_feature: GZ8MTXP02I9JDW.8.34.D01.1.454.CMB.2.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanagccaccctctcctgcagggccagtcagaatgttgcgcctagtatcctggtaccaacagaaacctggccaggcctcccaggcccctnatctatggncatccaanagggccacgtggcatcccagcctaggtcagtcggacagtgggtatggggacagcttcactctacaccatccatacagactgacgctagagatgttgctaagtttacttagtgttacaaagtactacgtaaccgagtacggccgtcccgggggcctacgtttccggacccgttacgggaacctaaaacggtggaacttacgtaacaaaacggactagtgacgtcgacaactgtactcgttactctaccg

SEQ ID NO: 332525 - DNA, 575 bp, Homo sapiens
  misc_feature: GZ8MTXP02GKRS3.8.34.D01.1.454.CMB.2.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagctcgcgtgtccacgaccggtgctcgatttagatcgtctgtgttgagctctgggagaggagcccagcactagaagtcgggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctcgtgggttcaccttnagtaactacggcatgcacgtgggtccnccaagctccgaggcaagggattgggagtggggtgctaggttgtttcagtctggagggcaggttgttcagtggtatgcagactccggtagaagggccgtattcacatcctacagagaacaattccgaagaaacacaatgtattggatctagaacacgtctaaacgtcctagacggacgacgggtactataacgtacgtaggtaacggaaacggggacgggggaaaccgaagggacgggtaacgttaccgaacgtaccttaccgttacggtaccgg

SEQ ID NO: 332526 - DNA, 648 bp, Homo sapiens
  misc_feature: GZ8MTXP02F1TQG.8.34.D01.1.454.CMB.2.raw
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagcctcgtggttcaccttcagtaactacggcatgcacgtgggtcccnccaagcctccgaggcgaaggnttggaggtgggtggctagtttgttcagtcgtggagggctaggtgttacaagttgggtatgacgacgtaccgtccgtaggaacggccgtacttccgaacctactcaccgaagacgaactaaacgttacccgaaggaaaacctaacgtaaagttgttaagtttaggagtactaaggaaacacgtacctaagtccgtaggacggaacgacggggtacttaacgtaacgttaggtacggtaaacggaaacggggacgggggaaacgagggtaccgggtaaacgttaccgtaaacgttacctccgtttacggaccggttacggtaccggggg

SEQ ID NO: 332527 - DNA, 635 bp, Homo sapiens
  misc_feature: GZ8MTXP02HYLMP.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgctacgtatcctggtaccaacagaaacctggccaggcctcccacggcccctcatctatggtcgctactcccaaacgacggggcccaacgtgggccaactccccgaagcccctaagggttccaaggtcgggctagggtcggggtaatggggacaggtaccttcaactcctccaaccctatcatcacgcgtgacgctagagtagtgtgctagtttattactgtacaactagtaccgtacgacgtcggcccgtcccgggggtccctacggtttccggcccgtacggggtaacccgtaaaaggtcgggtaaacttaacgtaaccgtaaaaaccggtaccgttaggtacggcgtcggacctaaccgtacttaccttacggtttctttacctaccg

SEQ ID NO: 332528 - DNA, 571 bp, Homo sapiens
  misc_feature: GZ8MTXP02HKUY4.8.34.D01.1.454.CMB.2.raw
  modified_base (298)..(298): a, c, t, g, unknown or other
  misc_feature (298)..(298): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgcacgtgggtcccnccaagctccaggcaagggatggagtgggtggctagttgtttcatcgtgagggcagtgttcaagttggtatgacagactccgtaggaacgggccgattcaccatctcagagactaatccaagacacaatgtattaggagctagaacacgactaacgcctaggacggacgacggacgtaactactacgtacgtaacggaagggaacgggggaaccaggacggggaacgttaccgaaacggttacttaccgtttacggacggttacgtaccggggg

SEQ ID NO: 332529 - DNA, 577 bp, Homo sapiens
  misc_feature: GZ8MTXP02FO7WE.8.34.D01.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttcagtaactacggcatgcacgtgggtcccncaagcctccgaggcaagggnttgggagtggggtgcagttgtttcatctggagggctagtgttcagtggtatggcagactccgtgaagggccgattcaccatctccagagacaattccaggaacacaaatgtatttaggagactagaacacgcgtaaacgtccgtagacggacgacgggtacgtaagtactaacgtacggtaaccggaaaggggaacgggggaaaccgaagggtacgggtaacggttaccgaaaggttaccttccgtttacgtacccgg

SEQ ID NO: 332530 - DNA, 598 bp, Homo sapiens
  misc_feature: GZ8MTXP02HUL50.8.34.D01.1.454.CMB.2.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacctgtcttcgtctccgaaggggaaancgccaccctctcctgcagggccagtcagatgtgcnctagtatctgtacaanagaaccnggccaggcctcccagcccctnatctagtggtncatccaaacgnggccacgtggacactcccagcccgtaggttcaggtcggactaggtggggtatggggaacagtaccttcactctacaacctgtcactcacgccgtggacgtcccgtagaggtatggttgacgttagtttatactgtacaagtataccgacgtagtcggcccggtccgggggccctacggtttcccggacccgtacggggaaacccgtaaaaggtcgggtaaacttaacgaaccgtaaaacgtaacgtcggtcggactcgaccgaacctagtacctcgtctttactcccg

SEQ ID NO: 332531 - DNA, 566 bp, Homo sapiens
  misc_feature: GZ8MTXP02FLTCD.8.34.D01.1.454.CMB.2.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (558)..(558): a, c, t, g, unknown or other
  misc_feature (558)..(558): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccaaccaccctgtcttcgtctccaggggaaanagccaccctctcctgcagggccagtcagaatgttgcgcctacgtatcctggtaccaacagaaacctggccaggcctcccaggcccctnatctatggtgcatccaacgagggccactggcatcccagccagtcagtgcagtggatgggacagcttcactctcaccatcatcacgcctggacncgtgaagtntgttgacttagtttacttactgtacaatcgtacgtacgtacggtcggtccccggtcggggtacctaccggtttccggacccgtacgggtaaccgtaaaggtcggtactacgtaaccgaaaacgtacgtagtcgactagaaccaactctctcgttcttacnctttcccg

SEQ ID NO: 332532 - DNA, 577 bp, Homo sapiens
  misc_feature: GZ8MTXP02H26GS.8.34.D01.1.454.CMB.2.raw
  modified_base (274)..(274): a, c, t, g, unknown or other
  misc_feature (274)..(274): n is a, c, g, or t
  modified_base (332)..(332): a, c, t, g, unknown or other
  misc_feature (332)..(332): n is a, c, g, or t
  modified_base (438)..(438): a, c, t, g, unknown or other
  misc_feature (438)..(438): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagccgtgggaggtcacagagactctcgtgtgcagcctcgtggttcaccttnagtaactacggcatgcacgtggggtcccaccaaggcctacccgaggccgaaaggggtntttggggaggttggggtggactaggttgtttcagtcgtggagggctagtgttacagtggtatgcagctcgtagacggcgatcacatctcagagacaatcaagacanaatgtattagagcagacacgtacgtaacgtcgtagacggacgacggacgtagtacgtacgtacggtaacggaaggggaacgggggaaccgaagggacgggtaacgttaccgaacgtaccgttaccgtttacggtaccgg

SEQ ID NO: 332533 - DNA, 582 bp, Homo sapiens
  misc_feature: GZ8MTXP02I3HHB.8.34.D01.1.454.CMB.2.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
  modified_base (410)..(410): a, c, t, g, unknown or other
  misc_feature (410)..(410): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagatgtggcncctagtatcctggtaccaanagaaacctggccaggcctcccgaggccccctnatctatggtnctatccaaacncggggccacgtggcactcccagccaggttcaggtcggacaggtgggtatgggacagtcttcactcacacctatcatcagcctgacgctgaggntgttgctagtttattactgtacaactgtacgtaccgagtcggcccgtccgggggcctaccgttccggacccgtacgggaacccgtaaaggtcggtaactaacgtaacgaaaaccggtaaccgttacgggtacggaccgtcgaccgtacctatcgttacgttaccttctaccg

SEQ ID NO: 332534 - DNA, 753 bp, Homo sapiens
  misc_feature: GZ8MTXP02GA3V9.8.34.D01.1.454.CMB.2.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaggggaaagagccacccctctcctgcagggccagtcagatgtggcgcctagtatcctggtaccaacagaaacctggccaggcctcccacggccccctnatctatggtgcactccaacgacggggcccaacgtcggccactcccccgaagcccgtaagggtttccaagggttcggaccgaaggtttgggggtaatcgggggaacctagggtcctttccaaccttctaccaaccctaattccaataccacgtcccgtagggaacgtccgttaggaagggtattggttaggtacttaaggtttttaactttaaaccgttggttaaccctaaacgtacgtttacccgggttaacccgggtaacgggttccggggtacccccggttaccccgggggggtccccttaacccgggttttccccggggaccccggtttaccgggggaaaacccctaaaaggggttccgggtaaacttaacgttaaccgaaaaccggtaaccgttacggtcggtaccgttcggaccctaacctacgttacttacggttcctttaccttacc

SEQ ID NO: 332535 - DNA, 575 bp, Homo sapiens
  misc_feature: GZ8MTXP02I4YWN.8.34.D01.1.454.CMB.2.raw
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
  modified_base (452)..(452): a, c, t, g, unknown or other
  misc_feature (452)..(452): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggaggcgtggtccagccgtgggaggtcacagagactctcgtgtgcagcctctgggttcaccttcagtaactacggcatcgcacgtggggtcccnccaagcctccgaggcgaaagggnttagggagtggggtgctaggttcgtttcagtcgtggaggctagtgttacagtggtaatgacagactccgtagaacgggccagttccacatctacagagacaatacaagaacacatagtattggaagntaagacacgactaagtccgagacgacgcggactaactacgtacgtacgtaacggaaacggggacgggggaaaccaagggtacggaacggttacccgaagttaccgtaccgtttaggtaaccgg

SEQ ID NO: 332536 - DNA, 531 bp, Homo sapiens
  misc_feature: GZ8MTXP02HXNSX.8.34.D01.1.454.CMB.2.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (401)..(401): a, c, t, g, unknown or other
  misc_feature (401)..(401): n is a, c, g, or t
tcagctcgcgtgtccacgaccggtgctcgatttagatcgtctgtgttgggtttgggagctctgggagaggagcccagcactagaagtcggcggtgtttccattcggtgatcggcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtactacggcatgcactgggtccnccaagctccaggcaagggnttgggagtgggtgctagttgttcatctgagggcagtgttcagtggtatgcagctcgtgaggcattcacatctcagaganatcagaacacaatgtattgagactagacagactaagtcctagagacgacgggacgttaatactacgtaggtacggaacgggagggggaaccaaggacgggacgttaccgaagtaccgtctttacggacgg

SEQ ID NO: 332537 - DNA, 627 bp, Homo sapiens
  misc_feature: GZ8MTXP02HS9Q8.8.34.D01.1.454.CMB.2.raw
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctccccaggcccctcanctatggtncanccaagaggcactggcacnccacgcagtcgagtcgngagtggtagtggacgagctactactctccaaccaactacactacacgaccgtcggacggtccgtacgtaggtagttagttggtacgtagtttaaacgtttaacttagttactaaactaacgtacgtaaccggtaacggtacgggtcccggtacccgggggtacccggtaccgtttaccggtcccggtacgggtaaccggtaaaacgtaaacggtaagtaaacgtaacgtaaaacgtaaaacgtaacgtaggtcgtcgtacgaacactactacttcttactac

SEQ ID NO: 332538 - DNA, 681 bp, Homo sapiens
  misc_feature: GZ8MTXP02ITY51.8.34.D01.1.454.CMB.2.raw
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagctctcgtgtgcagcctctggttcaccttnagtaactacggcatggcacgtgggtccncaagctccaggcaagggnttgggagtgggtggctagtttgttcatcgtgagggctaggtgttacagttgggtaatgactaggtacgtccgggtaggaaacggggtccgtacttacgaaccctattccctaccgacgaacgaactaaacttaccgaaggaaaccaaactaaagtagttaagttttagggaggtactacggaaccgaacgtaccgtaaacggtcccgttaaggaacggggtaaccgtaaccggggtacgttaactaacggttaaccgtaacgggtaaacgggaaaacgggggtacggggggaaaacccgtaacggggaccggggtaacggtttaacccgtaaacggttaaccgtttaccgtttacggttaaccgggg

SEQ ID NO: 332539 - DNA, 555 bp, Homo sapiens
  misc_feature: GZ8MTXP02I74B0.8.34.D01.1.454.CMB.2.raw
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggagcgtggtccagcctgggagtcacagagactctcgtgtgcagcctctgggttcaccttnagtaactacggcatgcactgggtccgcaagctccaggcaaagggtntggagtgggtgctagttgttcatcgnggaggctagttgtcaagttggtntgcagacgtcgagaacgggcactcacactcncaganacatacagacacatgtatganctagaacacgactacgtccgaggacggacgacgggtacgtaacgtacgtacgtacggtaacggaacggggaacgggggaaccgagggacgggaacgtaccgtaacgtaccgttaccgttacggtacgtcggtcggg

SEQ ID NO: 332540 - DNA, 705 bp, Homo sapiens
  misc_feature: GZ8MTXP02JX2O7.8.34.D01.1.454.CMB.2.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctctgggttccaccttcagtaactacggcatgcacgtgggtcccncaagcctccgaggcaagggnttgggagtggggtggctaggtttgtttcattcgtggagggtctaggttgttacaagttgggtatgacagtaccgtccggtaggaaacggggtcccgtaacttccgaaccctactccgtacccgaagaacgtaacctaaacgttacccgaaagggaaaccaaacgtaaagttaggtttaaacgtttagggaacgtacgtacggtaaaaccgacggtacccgttaaacggttcccgtagggaacgggtaccgaaccggggtacgttaaacgttaaccgttaacggtagggtaaacgggaaacgggggaacgggggaaaccgtacggggacggggtaacgttaccgaaacggttaccgttaccgttacggtaccggtcggttaccggggg

SEQ ID NO: 332541 - DNA, 567 bp, Homo sapiens
  misc_feature: GZ8MTXP02JTCNB.8.34.D01.1.454.CMB.2.raw
  modified_base (306)..(306): a, c, t, g, unknown or other
  misc_feature (306)..(306): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtcccnccaagctccaggcaagggattgggaggtggggtggctagttgtttcatctggagggctaggtgttcatgggtatgcagctcgngaaggcgatcacntctccagagacaactccagaacacaagttcgtattaggagactagtaacacgacctaagtcctaggacggacgacgggtactagtacgtacgtacggtaaccggaaggggagggggaaccgaaggtacgggacgttaccgaaggtacctaccgtttaggtaccgg

SEQ ID NO: 332542 - DNA, 642 bp, Homo sapiens
  misc_feature: GZ8MTXP02JI43T.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtgggaggtcacgagagactctcgtgtgcagcctgtggttcaccttcagtgactacggcatgcacgtggtccgaccaagcctaccgaggcgaaagggtattgggaggtgggtggctaggtttgttccattcgtggagggtcaggttgttacgaagttggtatcgacgagaccttcggtaggacgggccgtattacgacctatcctaccgaagacgaactaacttaccgaaaggaaacccaagtaacgttgttaagtttagggacgtacgtacgaaacacgtacctaaacggtccgtaggaacggaaccgacgggtacgttaacgtaacgttaacgtacggtaaacgggaaggggaaccgggggaaccgaacgggacgggtaacgttaccgaacgtttaccgtcggtttaacgg

SEQ ID NO: 332543 - DNA, 593 bp, Homo sapiens
  misc_feature: GZ8MTXP02GDLG9.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccaggcctggggaggtcacagagactctcgtgtgcagcctcgtgggtcaccttcagtaactacggcatgcacgtggggtcccaccaagcctaccgaggcaaggggattgggagtggggtgctagtttgtttcagtcgtggagggtctaggttgttacagtgggtaatggactagacgtccgtaggaacgggcctattccgacatcctaccagaacgactaactaccgagaaacacaaatagttattggaagtctaagaacacgacctaaagtccgtaggaacgacgacgggacttatacgtacgtacggtacggaaaggggacgggggaaccgaaggacgggacgttaccgaagtaccttcgttaggtaccgg

SEQ ID NO: 332544 - DNA, 618 bp, Homo sapiens
  misc_feature: GZ8MTXP02HOOXU.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagcctgggaggtcacagagactctcgtgtgcagcctcgtggttcaccttcagtaactacggcatgcacgtggggtcccaccaaactccgaggcgaaagggattgggaggtggggtgctagtttgtttcagttcgtggacgggcaggttgttacaagttggtatggctggacgccgtaggaacggcctatcacatcaccagacgaacaacctccgaacggaaacacaagttagttaatttacgaacccgtagaaacacggtacctaaacgtccgtaggacggacgtacgggtagtaagtacttaacgtagtaaacggaaggggtaacgggggaaccgacggacgggtacgtccgtaaagtccgtaccgtttacggacgtcggtcgggaccgtacggg

SEQ ID NO: 332545 - DNA, 536 bp, Homo sapiens
  misc_feature: GZ8MTXP02H6SV7.8.34.D01.1.454.CMB.2.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccagggggaaanagccaccctctcctgcagggccagtcagatgtgcnctagtntcctgtacaangaactgccagctccaggccctnatctatggtgcatccaacnggccatggcatcccanccaggtcagtgcagtggtatgggacagcttcactctacaccatcatcagcctgancctgaggatgttgctagttattactgttacaactntacggtaccgagtcggccgtccgggggcctaccgtttcggcccgtacggggtaccctaaaaggtcgggtaaatacgtacgaaaacgtaactaggttggacctggacctaacactctacgtcttactc

SEQ ID NO: 332546 - DNA, 587 bp, Homo sapiens
  misc_feature: GZ8MTXP02G2P86.8.34.D01.1.454.CMB.2.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagatgttggcnctagtatctgtacaanagaacctggccaggcctcccagcccctcatctatggtgcactccaacgacgggcctacgttcgcactccccagccgtaggttcaggtcggcaggtgggtatgggacagcttcactctacaccatcatcagcctaggacgcctgaggtacgtgttgcttagtttattactgtacaactagtacgtacgagtcggccggtccgggggctaccggttccggaccgtacgggaacccgtaaaggtcggtaactacgtaaccgtaaaacgtaccgttagtcggaacgtcggaccctaccgtaacgttcctacgttacctttacttacccg

SEQ ID NO: 332547 - DNA, 815 bp, Homo sapiens
  misc_feature: GZ8MTXP02HNYAE.8.34.D01.1.454.CMB.2.raw
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggtctgaactgggttttcctcgttgcttcttttaagaggtgtccagtgtcaagtgcaactggtggagtcgtggggagcgtggtccagcctgggaggtcacagagactctcgtgtgcagcctgtggtcaccttnagtaacncggcatgcacgtgggcccncaagcctccgaggcgaaaggnttgggagtggggtggctaggtttgtttcagttcgtaggaggggtctagttgttacaaagttgggtatgactaacggtacccgttaccgggtagggaaaacggggtccccgtaacgtttacccaaacccccgtaatttaccccgtaacccgtaaaggtaaaccgaaacccgttaaaacgtttaacccccgaaaagggggtaaaacccctaaaacgttaaaacgtttacggtttaaacggtttttacgggaaaggtaccggtttaaacggaaaaaccgtacgtaaaccccgttaaacggttaccccggttaagggaaccgggaaccggtaacgggggtaacctttaaaacgtaaccccgttaaggttaaacggtaaaccgggggtaaaacgggggaaccggggggtaaaaccgaacgggggtaccgggggtaaacggtttaacccgaaacggtttacccgttaccgtttaccgggtaccgggtttaccggtaacccgggggg

SEQ ID NO: 332548 - DNA, 590 bp, Homo sapiens
  misc_feature: GZ8MTXP02HHSDV.8.34.D01.1.454.CMB.2.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (388)..(388): a, c, t, g, unknown or other
  misc_feature (388)..(388): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccatcctgtcttcgtctccaggggaaanagcccacctctcctgcagggccagtcagaatgttggcgcctacgtatcctggtaccaacagaaacctggccaggctcccaggcccctnatctatggtgcatccaacgacgggccacgtgggccaactccccaagtcccaggttcacggtggactaggtggggtatggggacaggaccttnactctcaccatcatcacgccgtcggacgccgtgaggattgttgacgtagtttattacttgtactaacatacgtaccgtagtcggccgttccgggggcctacgttccggccgtacggtaccgaaaggtcggtaactacgtaccgaaaacgtaacgttcggtacggaacgtacggaccaccgtacttccgtacgttcctttacc

SEQ ID NO: 332549 - DNA, 570 bp, Homo sapiens
  misc_feature: GZ8MTXP02GP2L5.8.34.D01.1.454.CMB.2.raw
  modified_base (308)..(308): a, c, t, g, unknown or other
  misc_feature (308)..(308): n is a, c, g, or t
  modified_base (445)..(445): a, c, t, g, unknown or other
  misc_feature (445)..(445): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgttggcgcctagtatcctggtaccaacagaaacctggccaggcctcccaggcccctcatctatggtncatccaacgcgggccactggcatccccagcctaggtcagtcggcaggtgggtatggggacaggtcttcactctcaccatcatcagccgtggacgccgtagacggattggttgcttagtttattactgtacaaacgtntccgtacggtagtcgggcccgtccgggggcctaccgtttccggcccgtacgggaacctaaagggtcgaataactacgaaacgtacgtaggtcggactcggacacgtactctcgtccttactaccg

SEQ ID NO: 332550 - DNA, 642 bp, Homo sapiens
  misc_feature: GZ8MTXP02GO4AX.8.34.D01.1.454.CMB.2.raw
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccagggggaaagagccaccctctcctgcagggccagtcagatgttgcnctagtatctgtaccaanagaactggccaggctcccaggcccctanatctatgncatccaacgcggccagtggcactccagccgtaggtcaggtcggacgaggtggggtatcggggactagtaccttcacttcctaccaacctagtaccatcgacgtcccgtaggacgcgtagggaggtagttggttacgtacgttagtttagttacgttagtaactaacgtacgtaccgtaacggtacggtaccgggtcccgggtacccgggggtacccttaccggttccggacccggtaacgggtaaaccgtaaacgggtacggtaaactaacgtaaacgaaaacggtaacgtacggtacggtcgtaacgacctaacgtacttaccgtacgttaccttactaccg

SEQ ID NO: 332551 - DNA, 723 bp, Homo sapiens
  misc_feature: GZ8MTXP02HURI5.8.34.D01.1.454.CMB.2.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctgggagtcacagagactctcgtgtgcagccctcgtgggttcaccttcagtaactacggcatgcacgtgggtcccnccaagcctccgaggcaagggtntgggagtgggtgcgtagttgttcatcgtgagggctagttgttacagtggtatcgcgtaagaccgttccggtaggaaacggggtcccgtaacgttccaaccctacgtcccttacccgaacggtaaacgaacctaaacgtttacccgaaacgggtaaaacctaacgtaaaagtttacggtttaagttttacggggaaggtacgttaacggaaaccgtacggtaacccgttaaagttacccgttaggaaacgggtaacgtaaccggggtacgtttaaactaaccgttaacggttaacgggtaaacgggaaaacgggggtaacgggggaaaccgaacgggggtaaccggggtaacggttacccggtaaacggtttaccgtttaccggtttacggttaacccggg

SEQ ID NO: 332552 - DNA, 624 bp, Homo sapiens
  misc_feature: GZ8MTXP02GAOAZ.8.34.D01.1.454.CMB.2.raw
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttccaccttcagtaactacggcatgcacgtgggtcccnccaagcctccgaggcgaaagggnttgggagtggggtgctagttgttcatctggagggcagttgttcatgggtatgacagactcgtagaaacgggccgtattccacatcctaccagacgaactaattaccgaaggtaaacaactaatagttagtttggacgtcgtaagaacgagtaccgttaaacgtccgtaggacggaaccgacgggtacgtaactaaccgtaacgtacgggtaaaccggaaacgggggaacgggggaaaccgaaggggtaccggggtaacgttacccgaaacggtttaccgtaccggtttacggtaacccggg

SEQ ID NO: 332553 - DNA, 676 bp, Homo sapiens
  misc_feature: GZ8MTXP02IG8J3.8.34.D01.1.454.CMB.2.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccagggggaaagagccaccctctcctgcagggccagtcagatgtgcncctagtatcctggtaccaanagaaacctggccaggcctcccgaggccccctanactctagtggtcactactaccaaacgacgggccaacgtcggacctacctccccgagtaccgtaggttcaggtcggacgtaggggtagggtagtgggaacacgtccttcaccttcctaccaacctataccatacgacgccgtacggacgtcgtagaggtagttgtgtacttagtttacttacgttacgtaacctaacgtacgttaccggtaccggtacgggtccgggtacccgggtcccgggggtacccttaccgggtttcccgggtacccggtacggggtaaaccgtaaacgggtacggtaaactaacgtaaaccggaaaacgtacgtacggtacgacgtaacgtaccaacttactccgttacgtttccttacctacg

SEQ ID NO: 332554 - DNA, 725 bp, Homo sapiens
  misc_feature: GZ8MTXP02HGC93.8.34.D01.1.454.CMB.2.raw
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtggtcaccttnagtactacggcatgcacgtggtccnccaagcctccgaggcaagggattgggagtggggtgctaggtttgttcccagttcgtaggacgggtctaggttcgttacgaaagttgggtatcgactaaggaccgttcggtaggtaacgggcccgtattaccaacctattcctaccgaagaacgtaacctaaacgttacccgaaaggaaacctaacgtaaagttaggttaagtttagggaacgtaccgttaacggaaaaccgtacgtaacccgttaaacggtacccgtaagggaaccgggtaaaccggaacccggggtacgttaaacgttaaaccgtaaacggttacgggttaaaaccggggaaagggggaaaaccggggggaaacccgaacgggggtaaccggggtaacggttaacccgtaaaccggtttaacccgttcccgtttaacgggg

SEQ ID NO: 332555 - DNA, 530 bp, Homo sapiens
  misc_feature: GZ8MTXP02GB259.8.34.D01.1.454.CMB.2.raw
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (374)..(374): a, c, t, g, unknown or other
  misc_feature (374)..(374): n is a, c, g, or t
  modified_base (424)..(424): a, c, t, g, unknown or other
  misc_feature (424)..(424): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctggggaggtcacagagactctcgtgtgcagcctctgggttcaccttcagtaactacggcatgcactgggtccnccaagctcaggcaagggnttgggagtggggtgcagttgtttcatctgagggcagtgttcagtggtatgcagactcgngaaggcgatcacatctcagagacaattaccagaacacaatgtattggagntagaacacgacctaagcctagaggtacgacgggcgtatacgtactaggtaacggaagggacgggggaaccgaaggcggacgttaccaagtacgtccgttagtaccg

SEQ ID NO: 332556 - DNA, 643 bp, Homo sapiens
  misc_feature: GZ8MTXP02FQ7ZI.8.34.D01.1.454.CMB.2.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctgtgtgcagcctcgtggtcaccttcagtaactcggcatgctacgtcgggtcccncaagcctccgaggcgaagggtnttgggaggtggggtgctagtttgtttcagttcgtggagggtctaggttcgttacagttggtaatgacagtacgtccgggtaggaacggggccctagttaccacctagtcctaccgagtaacgaactaacgttaccgaaaggtaaacaacgtaaagttaggttagtttaggagtactagaacgacgtaccgttaacgtccgtaggaacggaaccggtacgggtactatacgtaacgtaaggtaacgggaaacggggaacgggggaaaccgaagggacgggtaacgttaccgtaaagttaccgttaccgtttacggtaccgg

SEQ ID NO: 332557 - DNA, 699 bp, Homo sapiens
  misc_feature: GZ8MTXP02F2YJK.8.34.D01.1.454.CMB.2.raw
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggaggtcacagagactctcgtgtgcagtcctcgtgggttacaccttnagtaacctacggcagtgcacgtcgggtccnccaaagcctccgaggcgaagggtattgggaggttcggggtaggctaggtttgtttccgagttcgtagggacggtctaggttcgttcaaagttgggttaagcgaccgtaacggtaccgtaccggtagggacggtaccgtactaccactactacctacgaacgacgaactaaacgtacgaaacgtaaacaacgtaagttagttagttaggacgacgtaacgaaacgtacgtaaccgtaacgtaccgaggaacggaacggtacgggtaccgttaaacgttaaccgtaacggttaacgggtaaacgggaaacgggggtaaaccgggggaaccgtaacgggaaccggttaaccgttaaccgtaaacggttaccgtttacggtttacgg

SEQ ID NO: 332558 - DNA, 563 bp, Homo sapiens
  misc_feature: GZ8MTXP02FSPK5.8.34.D01.1.454.CMB.2.raw
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (381)..(381): a, c, t, g, unknown or other
  misc_feature (381)..(381): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgtgcncctagtatcctgaccaanagaaacctggccagctcccagcccctnatctatggtncatccaanggccacgtggcatcccagccaggttcagtcgcagtggtatgggacagcttcactctcacatcatcagcctganctgagatgtgctagttattatgtactaacatacgtacgagtcggacccgtccgggggtacctacgtttccggacccgtaggggaaccctaaaaggtcggaaattaacgtacgaaaacggtaacgttacggtcggtacgtaacggaccgtaaccgtactacgtttacgtcctttacgtaaccg

SEQ ID NO: 332559 - DNA, 675 bp, Homo sapiens
  misc_feature: GZ8MTXP02JNI36.8.34.D01.1.454.CMB.2.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
  modified_base (401)..(401): a, c, t, g, unknown or other
  misc_feature (401)..(401): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccagggggaaanagccaccctctcctgcagggccagtcagatgtggcnctagtatcctgtaccaacagaaacctggccaggctcccaggccccctnatctatggtcgcactcccaacgacggggcccaacgtggcccactcccgagccctagggttccaggtcgggcaggtggggtatggggacaggaccttcactctccaacntcaactcacgtcccgtggacgtccgtaggaacggtattggttcgtacgttaagttttacttacgttcgttacctaaacgtacgttaccggttacccgggtaggttccggggtcccggttacccggggggtccttaccccggttttaccggggccccggttaacggggaaccccgtaaaagggtacgggtacttaaacggtaaccgaaaacgtaccgttagggtcggacgttaacggacccgtaaccgtacttccgtacggttcctttacgtccc

SEQ ID NO: 332560 - DNA, 671 bp, Homo sapiens
  misc_feature: GZ8MTXP02J4DWM.8.34.D01.1.454.CMB.2.raw
  modified_base (396)..(396): a, c, t, g, unknown or other
  misc_feature (396)..(396): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagcctggggagtcacagagacctctcgtgtgcagtccctgtgggttccaccttcaagtaactacggcatgccacgtggggtcccgccaaggcctccgaggcgaaaggggtattggggagtggggtgctagttcgtttcagtcgtggagggtcaggttgttacaagttgggtangacacgcgtcgaggaacggtcctactaccactactaccgtacgaagacgaactaactacgaaacggtaacaacgtaagttagttagttaggacgtacgaacggaacgacgtaaccgttaaacggtccggtaacggaccggaaccggtaacgggtactaacgtaacgtaacggaacgggtaaacgggaacgggggaaccggggtaaccgacggggtaaccggtaacgttaaccgtaacggttccgttaccggtttacggaccggttacggtcgggg

SEQ ID NO: 332561 - DNA, 565 bp, Homo sapiens
  misc_feature: GZ8MTXP02JAX6B.8.34.D01.1.454.CMB.2.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagcccaccctctcctgcagggccagtcagatgttggcgcctacgtatctggtacaacagaaacctggccaggctcccaggcccctnatctatggtncatccaaacgagggcccaacgtggccacgtcccagccctaggttcaggtcggcaggtgggtatggggacagccttcactctacaccatcatcacgccgtggacgcctagagtatgttagactagtttattacgtgtaccaactatccgtacggagtcggccgtacccggggctacgttccggccgtaggacctaaaggtcgaataacgtacgaaaacgtacgtacggtcgctgaccacgtactcgtacgttcctactacc

SEQ ID NO: 332562 - DNA, 615 bp, Homo sapiens
  misc_feature: GZ8MTXP02GNS06.8.34.D01.1.454.CMB.2.raw
  modified_base (419)..(419): a, c, t, g, unknown or other
  misc_feature (419)..(419): n is a, c, g, or t
  modified_base (451)..(451): a, c, t, g, unknown or other
  misc_feature (451)..(451): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctcgtggttccaccttcagtaactcggcatcgctacgtcgggtccaccaagcctccgaggacgaaggggattgggaggttggggtgctaggtttgttccagtcgtggagggctagtgttcaagtggtatgcagactcgagacggcatcacatcncagacgacatcaagaacacagtgtagttaganctagaacacgtaccgtaagtccgtaggaacggaacgtacggggtactaaacgtaccgtaacggttacggaacggggaaacgggggaacgggggaaacccgtacggggtaaccgggggtaaacgttacccggtaaaacggtttccgtttaccggtttaaccgggg

SEQ ID NO: 332563 - DNA, 557 bp, Homo sapiens
  misc_feature: GZ8MTXP02IF9TO.8.34.D01.1.454.CMB.2.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
  modified_base (419)..(419): a, c, t, g, unknown or other
  misc_feature (419)..(419): n is a, c, g, or t
  modified_base (518)..(518): a, c, t, g, unknown or other
  misc_feature (518)..(518): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactgggtggagtcgtgggggagcgtggtccagccgtgggagtcacagagactctcgtgtgcagcctgtggttcaccttnagtaactcggcatgcacgtgggtcccncaagcctccgaggcaaggggnttgggagtgggtgctaggtttgttcatcgtggagggcaggttgttcagtggtatgacagactccgtagaacggggccattccacctatcctccaaganactaatccaagaactataaatgttattggagtctagaactagacctaagtccagacgacacgggctatactagcggtaacggaaggggacggggaaccnggtacggacgttaccgaagttaccttcgttacggaccgg

SEQ ID NO: 332564 - DNA, 565 bp, Homo sapiens
  misc_feature: GZ8MTXP02FY3QW.8.34.D01.1.454.CMB.2.raw
  modified_base (221)..(221): a, c, t, g, unknown or other
  misc_feature (221)..(221): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacccctgtctttcgtctccaggggaaagagccacccctntcctgcagggccagtcagaatgttggcgcctacgtatccctggtaccaacagaaacctggccaggctcccaggccccctcatctatggtgcatccaacaggggcccacgtggcaatccccagccaggttccagtcggcagtgggtatggggacaggcttcactctcaccatcatcagcctgggacnctgagatgtgntagtttattactntacacacgtacgtaccgaggtccggcccggtccggggtcctaccgttccggcccgtacgggaaccgtaaaggtggaatactaacgaaacgtacgtcggcgtacgcgacctacctactcgttacgtccttactac

SEQ ID NO: 332565 - DNA, 540 bp, Homo sapiens
  misc_feature: GZ8MTXP02IF2RS.8.34.D01.1.454.CMB.2.raw
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccacggagagattgtgttgacacaatctccagccaccctgtcttcgtctccagggggaaagagccaccctctcctgcagggccagtcagaatgttggcgctacgtatcctggtacaanagaaacctggccaggctcccaggcccctnatctatggtncatccaacnggccatggcatcccagccaggttcagtgcagtggatgggacngcttcactcctcaccatcatcancctggacnctgagtntgtgattagttattatntacaatacgtcgtacgagtcggccgtccggggtctacgttccggaccgtacggaaacgtaacggtagactaacgtaaacgaaaacgtacgtacggtcgacgtaacgacactacttcgtcgttcttactac

SEQ ID NO: 332566 - DNA, 757 bp, Homo sapiens
  misc_feature: GZ8MTXP02IXMSH.8.34.D01.1.454.CMB.2.raw
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (445)..(445): a, c, t, g, unknown or other
  misc_feature (445)..(445): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacctgtcttcgtctcgagggaagcgccacctctcctgcgagggccagtcagatggttggctcctacgtactccgtaggtaccaacacgaacctggaccacggcctccccgacggtccccctanactctagtggtacnctaactacccgaacggaccggggcctacgtcggaccactccccgacgtccgtacgggttcacggtcggacgtaggggttcgggtagtacgggaactacgtacctttccaacttccaccgaaccctnttaccgacttaccgacgtcccggtaggtaccgtccgtaggggaaggttgttacggtttacggtaacctttaaggttttactttaacgtccgttaaacctaacgttacgttacccgggtaaaccgggtgggtaccccggggtccccggggttcccgggggtacctttaccccgggtttccgggaccccgggttaacggggaaaccctaaagggtacggtaaaacgttacggtaaaaccgaaaaccggttcgtacggtccgtagtaacccggacaaccgttcgttccttaccggtttacctttaccgttacccg

SEQ ID NO: 332567 - DNA, 572 bp, Homo sapiens
  misc_feature: GZ8MTXP02GYKS1.8.34.D01.1.454.CMB.2.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttccaccttcagtaactacggcatgcactgggtccnccaagctccaggcaagggntgggagtgggtgctagttgttcatctgaggcagtgttacaagttggtatgacagactccgtaggaacgggccgattcacatctaccagacgacaatcaagaacacaatgtattggagctagaacagaccgtaagtccgtagaggacgacggacgtactacgtacgtacggtaacggaaacgggacgggggaaccgagggtaccgggaacgttaccgaaacgtaccgtaccgtttacggacggttacgtaccggggg

SEQ ID NO: 332568 - DNA, 717 bp, Homo sapiens
  misc_feature: GZ8MTXP02HT0UT.8.34.D01.1.454.CMB.2.raw
  modified_base (301)..(301): a, c, t, g, unknown or other
  misc_feature (301)..(301): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggagtcacagagactctcgtgtgcagcctcgtgggttccaccttcagtaactacggcatgcacgtgggtcccncaagctccgaggcaagggattgggagtgggtgctagtttgttcatcgtggagggtctaggtgttacaagttggtatgacagtaccgtccggtaggaaacggggtcccgtagttaccaacccgtactcctacccgaagtacgaacctaaacttacccgaaacgggtaaaccaacgtaaagttggttaaagttttacgggaagtacgttaacggaaaccgtacgtaacccgttaaacggtacccgtagggaacgggtaaccggaaccggggtaccgttaacgtaaaccgttaacggttaacggtaaacggggaaacgggggtaaaccggggggtaaacccgaaggggtaccgggggtaacgttacccgaaaacggtttaccgttacccgtttacggaacccggtttcggtaccggggg

SEQ ID NO: 332569 - DNA, 587 bp, Homo sapiens
  misc_feature: GZ8MTXP02H10OO.8.34.D01.1.454.CMB.2.raw
  modified_base (321)..(321): a, c, t, g, unknown or other
  misc_feature (321)..(321): n is a, c, g, or t
  modified_base (353)..(353): a, c, t, g, unknown or other
  misc_feature (353)..(353): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcccttgtgggttccaccttcaagtaactacggcatgcacgtgggcccacaagctaccgaggcaaagggnttgggagtggggtgctagttgtttcagttcgnggagggctaggtgttacaagttgtatgcagcgtccgtaggaacggcatcacatcacaganacatacaagacanatgtattgganactagaacagacctaagtccaggaacggacgacgggtacttactaccgtaagtacggtaaacggaagggggaacgggggaaccctaagggtaccggggtaacttaccgaaaacgttcccgttccgtttacggaccgtttacggccggggg

SEQ ID NO: 332570 - DNA, 541 bp, Homo sapiens
  misc_feature: GZ8MTXP02FYP22.8.34.D01.1.454.CMB.2.raw
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccaggcctgggaggtcacagagactctcgtgtgcagcctctgggttcaccttcagtaactacggcatgcacgtgggtcccncaagcctccgaggcaaggggnttgggagtggggtgcaggtttgttcagtctgaggcagtgttcatggtatgacagactcgtgaagggccattcacatcacaganacataccagaacacatgtattgantagacagacctaagtccgtagacggacgacgggactagtactacgtaggtaacggaacgggacgggggaaccaaggacgggtacgtaccgtaagtaccgtcgttacggtacgg

SEQ ID NO: 332571 - DNA, 628 bp, Homo sapiens
  misc_feature: GZ8MTXP02J1RBQ.8.34.D01.1.454.CMB.2.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanacgccaccctctcctgcagggccagtcagatgtgcnctagtatctgtacanagaactgcagcnccagccctnatctatggtncatccaacgagggccacgtggcactcccagccaggttcagtcggcaggtgggtangggacagtcttcactcacaccatcactcacgcctaggacgccgtggacggtattggttgaccgtttagttttacttacgttacggtaccaaacgtacgttaccggtaaccgggtagggttcccgggaccccggggttacccgggggacccctttaccgggtttccccggggaccccgttacggggaaaacccgtaaagggtacgggtaaactaccgtaaaccgaaaacgtaccgtggtacggactcggacctaacctacttaccgtcgttaccttactacccg

SEQ ID NO: 332572 - DNA, 560 bp, Homo sapiens
  misc_feature: GZ8MTXP02I5U55.8.34.D01.1.454.CMB.2.raw
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtggtccagcctgggagtcacagagactntcgtgtgcagcctctggttcaccttcagtaactacggcatgcacgtgggtcccnccaagcctccaaggcaaagggnttgggagtggggtgctagttgtttcatcgtgagggcagtgttacagtggtatgcagtactcgagaaggcatcacatctacagagacaataccaagaaacacaatgttatttggagactagaacagcctaaagtcctagaggacgacgggacgtaatacgtacgtacggtaacggaaaggggtaacgggggaaccgaagggacgggacgttaccgaagttacctacgtttacgtaccggg

SEQ ID NO: 332573 - DNA, 539 bp, Homo sapiens
  misc_feature: GZ8MTXP02IG2AU.8.34.D01.1.454.CMB.2.raw
  modified_base (501)..(501): a, c, t, g, unknown or other
  misc_feature (501)..(501): n is a, c, g, or t
tcagctcgcgtgtccacgaccggtgctcgatttagatcgtctgtgttgggtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaaggccgattcaccatctccagagacaattccaggaacacaatgtattggagctgaacagcctaagtcctgaggacacgggctatactactgtacgaggaggggaacagcgggagtcaagtactcttgacgtcgtggggccagggtaccctggtcaccgtctcctcacgcctcaccaacgggcccactccggtccttcccctggcccncccgtcgcctccgaaggacgcacctccgacgacgcacg

SEQ ID NO: 332574 - DNA, 583 bp, Homo sapiens
  misc_feature: GZ8MTXP02IAN0A.8.34.D01.1.454.CMB.2.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctctggttcaccttcagtaactacggcatgcacgtgggtcccncaagctacaggcaaggggnttgggagtggggtggcaggtttgtttcagtctggagggctagtgttacaagttggtatgcaggactccggtgaagggcccgattcacctatcctacgagacgacaacttccgaagaacacaaatgttaatttggagctagaacagacctaagtcctagaggacgacgggcttaacgtacgtacgtaggtaacggaaagggacgggggaaccaggacggggtaagtacccgaagtaccgttccgttacgacggttcgtaccggggg

SEQ ID NO: 332575 - DNA, 602 bp, Homo sapiens
  misc_feature: GZ8MTXP02G4G87.8.34.D01.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctctggtcaccttcagtaactacggcatgcacgtgggtcccnccaagctccgaggcaagggnttgggaggtgggtggctagttgttcagtcgtggagggcaggttgttacagtggtatggcagactcggtaggaacgggccagttccaccatcctaccgagacgaactaactaccgaaggaaacactaatgttagttggagactagaacagtacctaagtccgtaggaacggacgacgggacgtaataccgtacgtacggtaaccgggaaaggggaacgggggaaaccgaacgggacggggtaacggttaccgaacgttaccgttaccgtttacggtaacccggg

SEQ ID NO: 332576 - DNA, 553 bp, Homo sapiens
  misc_feature: GZ8MTXP02IWTO1.8.34.D01.1.454.CMB.2.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (368)..(368): a, c, t, g, unknown or other
  misc_feature (368)..(368): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagccctctgggttcaccttcagtaactacggcatgcacgtgggtccncaagctccaggcaagggnttgggagtgggtgctagttgttcatcgtgaggcagtgttacagtggtatgnagactcgtgaggcgattcacatctcagagacaatcagaacacaatgtattggagtctagaacagacctaagtccgtagacggacgacgggacgtaatacgtaacgtacggtaaccggaaaggggacgggggaaacccgaagggtacgggaacgttaccgaacgtaccgtcgtttacggtaaccgg

SEQ ID NO: 332577 - DNA, 661 bp, Homo sapiens
  misc_feature: GZ8MTXP02HEKT9.8.34.D01.1.454.CMB.2.raw
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctggggaggtcacagagactctcgtgtgcagcctcgtggtcaccttcagtaactacggcatgcacgtgggcccnccaagcctccgaggcaaggggnttgggagtgggtgcgtagttgtttcagtcgtggagggctagttgttacagttggtatggactaggtacctccgggtagggaaacgggccgtacttcacctagtcctaccagacgaactaacttaccgaaggaaacactaaagtagttagttaggacgtacgtaacgaacctacgaccgttaacggtccgtagggaacggaaccggtacggggtaccgttaagttaccgttaacggtaacgggtaaaccggggaaacgggggaacgggggaacccgaaggggtaccggggtaacgtttacccggtaaacggttaccgtttaccggtttacggtacccgggg

SEQ ID NO: 332578 - DNA, 611 bp, Homo sapiens
  misc_feature: GZ8MTXP02HA9W0.8.34.D01.1.454.CMB.2.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (469)..(469): a, c, t, g, unknown or other
  misc_feature (469)..(469): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtgggtccaggcctggggaggtcacagagactctcgtgtgcagcctgtggttcaccttnagtaactcggcatgcacgtgggtcccnccaagcctccgaggcaagggattgggagtggggtggctagtttgtttcagttcgtggaggggctaggttgttacaagttgggtatgacagacctccggtaggaacgggcccgtattccgacctatcctaccagagacaacttccgaagaacacaatgttagtttggganacgtagaacacgacctaacgtcgtaggaggacgacgggtacgtaactacgtacgtacggtaacggaaacggggacgggggaaccgagggtacgggaacgttaccgaacgtaccgttacgtttcggaccgtacggtaccgggg

SEQ ID NO: 332579 - DNA, 610 bp, Homo sapiens
  misc_feature: GZ8MTXP02GDVPK.8.34.D01.1.454.CMB.2.raw
  modified_base (299)..(299): a, c, t, g, unknown or other
  misc_feature (299)..(299): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagatgttggcgcctagtatcctggtaccaacagaaacctggccaggcctcccgaggccccctnatctatggtgcactccaaacgacgggccacgtggcactccccagcctaggttcaggtcgctaggtgggtaagtggggaacagtccttcaactctacaccatcatcacgccgtggacgccgtggaggattgttgtacttagtttacttacttagtactaaacgtagtaccgtaccggtaggtccggcccggtcccgggggtacccttaccggtttcccgggacccgtacgggaacccgtaaaggtcggaataacgtaacgaaaacgtaccgtaggtacgactgactaccctattcctcgttccttacttacc

SEQ ID NO: 332580 - DNA, 643 bp, Homo sapiens
  misc_feature: GZ8MTXP02FM3MD.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctcgtggttcaccttcagtaactacggcatgcacgtcgggtccgccaagcctccgaggacgaaggggattgggaggtggggtgctaggtttgtttccattcgtaggaggggtctaggttcgttcaaagtggtatgacagtaccgtccggtagaacggggcccgtagttaccaacctattcccacccgaagaacgaactaaacgttccgaaacggaaacaactaaagttgttaagtttaggaagtacgtagaaacacgtacctaagtaccgtagaacggacgacgggtacgtaactacgtacgtacggtaaacggaacggggaacgggggaaccgagggaccgggtacggttaccgtaacggtaccgttacgtttacgg

SEQ ID NO: 332581 - DNA, 703 bp, Homo sapiens
  misc_feature: GZ8MTXP02JHIU2.8.34.D01.1.454.CMB.2.raw
  modified_base (211)..(211): a, c, t, g, unknown or other
  misc_feature (211)..(211): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagngccaccctctcctgcagggccagtcagaatgttggcgctacgtatcctggtaccaacagaaacctggccaggcctcccgacggcccctnatctatggtncataccaacgacgggccacgtggaccactcccgagccaggttcaggtcggcgtaggtcgggtagtcggggaacacgtacgttcaacgttcctaccaacctatccataccacgtcccgtagggacgtcccgtaggacggtattgggttacgtacgttaaggttttactttaccgtaggttaccaaaacgttcgttacccgggtaacccggtagggtaccgggtcccccgggttacccgggggtaccccttaaccgggttttccccggggacccgttacgggggaaaccctaaaaggggttcggaaacttaacgtaaaccgaaaacggtacgttacgggtacggtaccgtaacggaccctaccggtacttccgttacgtttaccttacttacccg

SEQ ID NO: 332582 - DNA, 554 bp, Homo sapiens
  misc_feature: GZ8MTXP02F3DVG.8.34.D01.1.454.CMB.2.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (515)..(515): a, c, t, g, unknown or other
  misc_feature (515)..(515): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctctgggttcaccttnagtaactacggcatgcacgtcgggccnccaagctccgaggcaaaggggntggggagtggggtgctaggttgtttcatcgtggagggctagtgttcagtggatgcagactcgagacggcatcgactatctcagacgacaactccaagaaacacaaatgtattcggagctacgaacacggcctaagttccgagacggacgacgggacgtaactacgtacgtggaacggaaaggggacggggaaccngggacggtacgtaccgaagttaccgtccgttagtaccgg

SEQ ID NO: 332583 - DNA, 591 bp, Homo sapiens
  misc_feature: GZ8MTXP02HZHWG.8.34.D01.1.454.CMB.2.raw
  modified_base (272)..(272): a, c, t, g, unknown or other
  misc_feature (272)..(272): n is a, c, g, or t
  modified_base (326)..(326): a, c, t, g, unknown or other
  misc_feature (326)..(326): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggaggtcacagagactctcgtgtgcagcctcgtggtcaccttnagtaactacggcatgccacgtcgggtcccaccaagcctaccgaggcaaaggggnttgggagtggggtggctaggttgtttcagtcgtggagggctaggttgttacagttggtaatgcagtacctcgtaggaacgggccgattcacatctacgagacgacaactaccgagaaacacaatgttagttaggagtacgtagaacagtacctaagtccgtagacgaacgacgggacgtaataccgtacgtacggtaacggaacggggaacgggggaaccgaagggaccgggtacgttaccgaagtaccgttcgtttacgtacgg

SEQ ID NO: 332584 - DNA, 687 bp, Homo sapiens
  misc_feature: GZ8MTXP02ICKDF.8.34.D01.1.454.CMB.2.raw
  modified_base (274)..(274): a, c, t, g, unknown or other
  misc_feature (274)..(274): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtgggtggagtcgtgggggagcgtggtccagccgtgggagtcacagagactctcgtgtgcagcctcgtggtcaccttnagtaactacggcatcgcacgtgggccccgaccaagcctccgaaggcaaaggggtatttggggaggttggggtggctaggtttgttcagttcgtggagggctaggttgttactagtgggtatcgactaggccgtcgtaggaaaccggggtctacgtccactactcctaccgaagaacgaacctaacgttacccgaaacggaaacaacgttaaagtaggtttaagtttaggacgtacgtacggaaactacggtacctaaacggttaccgtacgggaacgggtaaccggtacgggtaacggttactaaaccgttacggtaacgggtaaacgggaaaagggggacgggggaaaaccgaacggggtacgggtaacggttaccgaaaacggtttacctttaccggtttacggaacccgg

SEQ ID NO: 332585 - DNA, 542 bp, Homo sapiens
  misc_feature: GZ8MTXP02F1JPG.8.34.D01.1.454.CMB.2.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (432)..(432): a, c, t, g, unknown or other
  misc_feature (432)..(432): n is a, c, g, or t
  modified_base (464)..(464): a, c, t, g, unknown or other
  misc_feature (464)..(464): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagcctggggagtcacagagactctcgtgtgcagcctcgtgggttcaccttcagtaactacggcatgcactgggtccncaagctccaggcaagggntggagtgggtggctagttgttcatctggagggcaatgttacaattgggtatgacagactccgtgaacgggccgatcaccatctcagagacaatccaagaacacaatgtattggantagaacagcctaagtcctagaggtacacgggngtactacgtactggtaacggaagggacgggggaaccaggacggaagtaccgaagtactcgttacgacgtcgtacgggg

SEQ ID NO: 332586 - DNA, 721 bp, Homo sapiens
  misc_feature: GZ8MTXP02G1CGR.8.34.D01.1.454.CMB.2.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctgtggttcaccttcagtaactcggcatgcacgtgggtcccncaagcctccgaggcaagggnttgggagtgggtgctagtttgttcagtcgtggagggtctaggtgttacaagttgggtatgacgagtaccgtccgggtaggaaacggggtcccgtaattccgaaccctagtcccgtaccgagaacgtaacctaacttacccgaaagggaaacctaacgtaaagtttggtttaaacgtttagggtaacgtacgttaacggaaaccgtaacggtacccgttaaacggtcccgtaagggaacgggaaccggtaccggggtaacgttaaacgttaaccgttaacggtaacgggtaaacggggaaacgggggtaacggggggaaaacccgaaggggtaccgggggtaaacggttacccgtaaacggttacccgttaccggtttacggtaaccggttcggtaacccggggg

SEQ ID NO: 332587 - DNA, 673 bp, Homo sapiens
  misc_feature: GZ8MTXP02GJSU7.8.34.D01.1.454.CMB.2.raw
  modified_base (305)..(305): a, c, t, g, unknown or other
  misc_feature (305)..(305): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttacttttaagaggtgtccagtgtcaagtgcaactggtggagtcgtgggggaggcgtggtccagccgtgggaggtcacgagagactctcggtgtgcagcctcgtgggttcaccttcagtaactacggcatgcacgtgggtcccncaagcctccaggcaagggattgggagtggggtgctagttgtttcatcgtggagggctaggttgttcaagttgggtatggacaggacctccgggtaggaaacggggtcccgtaattccaacctatccgtaccgaagtacgaactaaacttaccgaaaggaaccaactaaagtagttaagtttggaagtctagaaacgacgtaccttaaacggtcccgtaggaacgggaccgaacgggggtaccgttaactacgtaacgtacggtaaacggggaaagggggaaaccgggggaaccgaacgggtaccggggtaacgtttaacccgaaacggtttaccttcccggtttaggtaaccggttcggtaccggggg

SEQ ID NO: 332588 - DNA, 577 bp, Homo sapiens
  misc_feature: GZ8MTXP02IYO9U.8.34.D01.1.454.CMB.2.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtggggaggtcacagagactctcgtgtgcagcctgtggtcaccttcagtaactacggcatgcacgtgggtcccncaagcctccgaggcgaaggnttgggagtgggtgctagttgttcatctggagggctaggtgttacagttgggtatgactagacgtccggtaggaacgggcctatcacatcctacagagacaataccgaagaaacactaagtgttagttggagtactagaacacgtacctaacgtcctaggacggtacgacgggtactagtacgtacgtaggtaacggaaacggggacgggggaaccgaaggcgggtaacgtaccgaacgtacctacgttacgtaccgg

SEQ ID NO: 332589 - DNA, 695 bp, Homo sapiens
  misc_feature: GZ8MTXP02JQ1LM.8.34.D01.1.454.CMB.2.raw
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactgggtggagtcgtgggggaggcggtggtccaggccgtggggaggtcacagagactctcgtgtgcagcctcgtggtcaccttcagtaacctacggcatgcacgtgggccncaagccncgaggcgaaggggnttgggaggtggggtgctaggttgttcagttcgnggagggctaggtnttacagtggtatcgacagtacgtccggtaggacgggcctagttacccactatcccgtacagacgaactaacgttacccgaaagaaaccactaagttagttaacgtttacgggaccctaagaaaccgtacgtaccgttaacggtcctagggaacggtaaccgtacgggggttaataaacgttaccgttaaacggttaacggggtaaaaccggggaaagggggtaaaccggggggtaacccaagggggtaaccgggggttaacgtttaaacccggtaaacggttaccgtttacccggttttaacgggacccggtttacccggggg

SEQ ID NO: 332590 - DNA, 534 bp, Homo sapiens
  misc_feature: GZ8MTXP02IUH0R.8.34.D01.1.454.CMB.2.raw
  modified_base (292)..(292): a, c, t, g, unknown or other
  misc_feature (292)..(292): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggagcgtggtccagcctgggaggtcacagagactctcgtgtgcagcctctggtcacttcagtactacggcatgcactgggtccnccaagctccaggcaagggattgggagtggggtgctagttgttcatctgagggcagtgttcagtggtatgcagactcggtgaggcgatcacatctcagagacaatacagaaacacaatgttattggagactagaacagacctaacgtccgtagacggacgacgggacgtatacgtacgtagtaacggaaagggacgggggaacgaagggacggacgttaccgaagtacgtacgtttcgtacgg

SEQ ID NO: 332591 - DNA, 671 bp, Homo sapiens
  misc_feature: GZ8MTXP02H21UK.8.34.D01.1.454.CMB.2.raw
  modified_base (210)..(210): a, c, t, g, unknown or other
  misc_feature (210)..(210): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccagggggaaangccaccctctcctgcagggccagtcagaatgttggcgctacgtatcctggtaccaacagaaacctggccaggcctcccgacggcccctcactctatggtcgcactaccaaacgaggggtcccaacgtcggaccactccccgagtccaggttccagtcggctaggtgggatgggacagccttcaactcctacaacccatcactcgacgccgtaggacgtcccgtgaagggtactggttagaccgtttaagtttacttactggttaaccaacgtactaccggtaccgagttcgggaccccggtaccgggggtccctaaccggttttcccgggaccccgtacggggaaacccctaaaagggtacgggtacttaaacgtaacggaaaacccggtaaaccgtgggttacggaccgttaacggacccgtaacccgatttccggtacgttccgtttaccttaaccccg

SEQ ID NO: 332592 - DNA, 685 bp, Homo sapiens
  misc_feature: GZ8MTXP02HEKTE.8.34.D01.1.454.CMB.2.raw
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaagtggtggagtcgtgggggagcgtggtccaggccgtggggagtcacgagagactctcgtgtgcagcctcgtggttcaccttcagtaactacggcatgcacgtgggccnccaagcctccgaggcgaagggtnttgggaggtgggtgctaggttgtttcagttcgtggaggtctaggttgttacagttggtatcggactacgtacgtcggtagggaacgggtcctacttccaacctataccgtacgaagtaacgaactaacgttacccgaaacggaaactaaacgtaaagttacggtttaagtttacgggagtacgtaacgaaaccgtacgtaacccgttaagtcccgtaggaacggtaaccggtacgggtacgttaacgtaaccgttacggtaacgggtaaccgggaaacgggggaaccgggggtaaaccgaacgggggtaccgggtaacgttacccgtaacgttacccgttaccggtttacggtacccggg

SEQ ID NO: 332593 - DNA, 542 bp, Homo sapiens
  misc_feature: GZ8MTXP02JMH9F.8.34.D01.1.454.CMB.2.raw
  modified_base (299)..(299): a, c, t, g, unknown or other
  misc_feature (299)..(299): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (530)..(530): a, c, t, g, unknown or other
  misc_feature (530)..(530): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgttggcgcctacgtatcctggtaccaacagaaacctggccaggctccccacggcccctnatcctatggtgcatccaacaggggccacgtggcagtcccagcccaggttcagtcggacnggtggatggggaccngacttcacttctcaccntcatcagccctggagcctgaggatgttgctagtttattactgtacactatacgtaccgagtcggccgtccgggggcctacgttcggacccgtgggacctaaaggtgatactacgaaacgacgtacgtgactgcacctacnctgtacttctac

SEQ ID NO: 332594 - DNA, 588 bp, Homo sapiens
  misc_feature: GZ8MTXP02GDH7V.8.34.D01.1.454.CMB.2.raw
  modified_base (294)..(294): a, c, t, g, unknown or other
  misc_feature (294)..(294): n is a, c, g, or t
  modified_base (438)..(438): a, c, t, g, unknown or other
  misc_feature (438)..(438): n is a, c, g, or t
  modified_base (475)..(475): a, c, t, g, unknown or other
  misc_feature (475)..(475): n is a, c, g, or t
  modified_base (582)..(582): a, c, t, g, unknown or other
  misc_feature (582)..(582): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgagggaagagtcaccctctcctgcaggcagtcagatgtggcgctacgtatcctgtaccaacagaaacctggaccaggcctcccgacggccccctnactcctagtggtcgctatacccaaagacggggacccaacgtggaccactccccgaagtcccgaagggtttccaggtcgggaccagggttcggggtagtggggaaccagtaccttcacttctaccaccatcatcagccgtggacnccgtgagattgtagcgtagtttattactgtacaactntacgtacgagtcgtcccgtcggggcctacgttccggaccgtagggaacctaaggtcgatacgaacaaacgactacgtacgctaacgcaccgtatcgtcgttaccttntacccg

SEQ ID NO: 332595 - DNA, 809 bp, Homo sapiens
  misc_feature: GZ8MTXP02GDD3V.8.34.D01.1.454.CMB.2.raw
  modified_base (272)..(272): a, c, t, g, unknown or other
  misc_feature (272)..(272): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctcgtggttcaccttnagtaactacggcatgcacgtcgggtccgccaagctccgaggacaagggattgggagtggggtggctaggtttgtttcagttcgtggagggctaggttgtttacaaagttgggtatggacctaagggtaccttcccgggtagggaaaacgggggtcccgtaacgtttaccgaaaccctacttaccttacccgaaagaaacggaaacccgtaaaactttaccccgaaagggaaaacctaaacctaaaacgtttaggtttaaagttttacggggaagtacgttaacgggaaaaccgaacggtaacccgtttaaaacggttcccgttaagggaacggggaaaccgtaaccgggggtaccggttaaaacttaaaccggtttaaaccgttaacggggttaaaaccggggaaaacgggggaaaccggggggggtaaaacccgaagggggtacccgggggtaaacggtttaaccccggtaaaaacggtttacccgtttaacccggttttacgggtaacccggtttaccgggtttaacccgggggg

SEQ ID NO: 332596 - DNA, 574 bp, Homo sapiens
  misc_feature: GZ8MTXP02GKY50.8.34.D01.1.454.CMB.2.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (446)..(446): a, c, t, g, unknown or other
  misc_feature (446)..(446): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtggttcaccttcagtaactacggcatgcacgtgggtccncaagctccaggcaagggnttggagtgggtgctagtttgttcatctggagggcagtgttacaattgggtatgcaagaccttccggaggaaacgggccgtattccaccatctaccaagagacaattaccagaaacactaaatgtaattgganctagaactacgacctaagtcctaggaggacgacgggacgtaactacgtacgtaggtaacggaaaggggacgggggaaaccgagggacggaagtaccgaacgttactaccgttaggacgtcgtacgggg

SEQ ID NO: 332597 - DNA, 647 bp, Homo sapiens
  misc_feature: GZ8MTXP02I7NA7.8.34.D01.1.454.CMB.2.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctcgtggttcacttcagtaactacggcatgcacgtgggtcccnccaagctccgaggcaagggnttgggagtggggtgctaggtttgttcatcgtggagggctaggttgttacaagttgggtatcgcaaggtaccttccggtaggaaacggggccctagttcaaccctatcctccgaagacgacctaacttaccgaaggaaacaacaaacgttagttatttagggagtacgtagaaaccgcgtaacccgtaagtcccgtaggacggacgacggggtacgtaactaccgtacgtacggtaaacggaaacggggtacgggggaaacccgaggggaccggggtaacgttacccgtaaggttaccgttaccgtttacggacggttcggtaccggggg

SEQ ID NO: 332598 - DNA, 641 bp, Homo sapiens
  misc_feature: GZ8MTXP02GHO3V.8.34.D01.1.454.CMB.2.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagcctcgtgggttcaccttcagtaactacggcatgcacgtgggtcccnccaagctccgaggcaaggnttggagtggggtgctagtttgtttcagtcgtggaggggctaggtgtttacgaagttgggtatgacaggtaccgtccgtaggaaacgggcccgtacttccaccctatccgtaccgaagaacgacctaaacgttacccgaaggaaaccaacgtaaagttgttaagtttggacgactagaaactacgaccttaacgtccgtaggacggacgacggggtactaacgtacgtacgtacggtaaacgggaaacggggaacgggggaaccgacggacggggtaacgttaccgaacgttaccttaccgtttacggacgttcggtaccgggg

SEQ ID NO: 332599 - DNA, 613 bp, Homo sapiens
  misc_feature: GZ8MTXP02I08HS.8.34.D01.1.454.CMB.2.raw
  modified_base (326)..(326): a, c, t, g, unknown or other
  misc_feature (326)..(326): n is a, c, g, or t
  modified_base (356)..(356): a, c, t, g, unknown or other
  misc_feature (356)..(356): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcgtggtccagccgtgggagtcacgagagactctcgtgtgcagcctcgtggttccaccttcagtaactacggcatgcacgtcgggtccgccaagcctccgaggcgaagggnttgggaggtgggtgctagttgtttcatcgnggaggctagtgttacagtgtatgcagtctcgtgacggcgtatcacactctacagacgacactacgagaaacaacgtaatagttagttaggacgtactacgaacgtacgtaccgtaaagtccgtaggaacggaaccggtacggggtacgttaacgtaacgttaacgttacgggtaaccgggaaagggggaacgggggtaaaccgaacgggtacggggtacgttaccgtaacggtaccgtttaccgtttaggtacccgg

SEQ ID NO: 332600 - DNA, 620 bp, Homo sapiens
  misc_feature: GZ8MTXP02FZLUM.8.34.D01.1.454.CMB.2.raw
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacagagactctcgtgtgcagcctctgggttcaccttcagtaactacggcatgcactgggtcccgccaagctccaggcaagggnttgggagtggggtggctagtttgttcattcgtggaggggcagttggttacaagttgggtactgcagtacctccggtagggaaacggggtccgtagttcaccatctaccagacgacaataccagaaacacaaatgtaagtttggagctagaaacacgtacctaaaggtcctaggaacggacgacgggtacgtaactacgtacgtaggtaaacgggaacggggacgggggaaaccgagggtacggggtaagttacccgtaaacggttaccgttaccgtttagggtaaccgtcggttaccggggg

SEQ ID NO: 332601 - DNA, 634 bp, Homo sapiens
  misc_feature: GZ8MTXP02GGM9Q.8.34.D01.1.454.CMB.2.raw
  modified_base (298)..(298): a, c, t, g, unknown or other
  misc_feature (298)..(298): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtgggtccagcctgggaggtcacagagactctcgtgtgcagcctctgggttcaccttcagtaactacggcatgcacgtggtccnccaagctccgaggcaagggattggaggtggggtggctagtttgtttcatcgtggagggcagtgttcaagttggtatgcagtaccgtccgtaggaacgggtccgattcaccatctccgaagacgactaactccaaggaaccaactaaagttgttaagtttagggacgtacttacggaaactaacgtacccgttaaacggtcccgtaggaacgggaccgtaacggggtaccgttaagtaaccgtacgtacggtaaaccgggaaagggggaacgggggaaaccgagggacgggtaacgttacgaacgtaccgttaccgtttacgtacggtcgtacgggg

SEQ ID NO: 332602 - DNA, 684 bp, Homo sapiens
  misc_feature: GZ8MTXP02FX6DI.8.34.D01.1.454.CMB.2.raw
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccaggcctggggaggtcacagagactctcgtgtgcagcctcgtgggttcaccttcaagtaactacggcatgcacgtgggtcccnccaagcctccgaggcaaggggtnttgggaggtgggtggctaggttgtttcagtcccgtaggaggggcaggttgttacaagttggggtatggacaagtccgtcggtagggaaacggggccgtacttccgaacctacgtcctacgaagacgtaactaacttaccgaaacggaaactaacgtaaagttagttagtttaggacgtacgttaggaaaaccacgtaaccctaaacggttacccgtagggaaacggacgaacggggtacgttaacgttaacgtaacgtacggtaaacggggaaagggggaaacgggggaaccgacggggtaacggggtacgttaaccggtaaacggttaccgttaccgtttacggtacggtttccgggg

SEQ ID NO: 332603 - DNA, 694 bp, Homo sapiens
  misc_feature: GZ8MTXP02JG0IE.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctcgtgggttcaccttcagtaactacggcatgcacgtggtcccgccaagcctccgaggcgaagggtatgggaggtggggtggctaggtttgtttcagttcgtggagggctaggtcgtttcgaagttggtatcgacgtagtacgtccggtaggaaacgggtcccgtacgttccaaccctactccgtaccgaacgaacgacctaaacgtttacccgaaagggtaaaccaacttaaaagttgtttaagtttagggacgtacgtacgaaacgaccgtaaccgttaaaggtcccgtaggaaccgggacgacggggacttaacgtacgtaacgtacgggtaaacgggaaacgggggtaacgggggaaacccgaggggtaaccggggtaacggttacccgtaaacggttaccgttaccgtttacggtacgggtccggtttacgggg

SEQ ID NO: 332604 - DNA, 752 bp, Homo sapiens
  misc_feature: GZ8MTXP02GQJIS.8.34.D01.1.454.CMB.2.raw
  modified_base (315)..(315): a, c, t, g, unknown or other
  misc_feature (315)..(315): n is a, c, g, or t
tcagctcgcgtgtccacgaccggtgctcgatttagatcgtctgtgttgggtttgggtagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccaggccgtgggagtcacagagactctcgtgtcgcagccctcgtgggttcaccttcaagtaactacggcatgccacgtggtcccnccaagcctccgaggcgaagggtattgggaggttgggtggtctaggtttgtttccagttcgtggaggggtctaggttcgttacgtaaagttggggtaatcggactaacgggtacccttcccgggttaggaaacgggggtcccgtaagtttacccgaccctaaacttcccgtacccgaacggtaacgaacctaaaacgttaccccgaaagggaaaacctaaccgtaaacgtttacggttaagtttaggggaacgtaccgttaacggaaacgtacggtaacccttaaacggttcccgtagggaacgggtaccgaaccggggtacgttaacgttaaccgttaacggtacgggttaaaccgggaaaagggggaacgggggaaaacccgacggggtaccggggtaacgttacccgaaacggtttaccgtttaccggtttacgg

SEQ ID NO: 332605 - DNA, 537 bp, Homo sapiens
  misc_feature: GZ8MTXP02HEQPA.8.34.D01.1.454.CMB.2.raw
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (340)..(340): a, c, t, g, unknown or other
  misc_feature (340)..(340): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctgtggtcaccttnagtaactcggcatgcacgtgggtccncaagctccgaggcaagggnttggagtgggtgctagttgttcatcgngagggcagtgttacagtggtatgcagtactcgtaggaacggcatcacatcncaganactactcaagacanatgtattganctagaacacgtactaagtcctagacgacgacggactatacgtacgtacgtacggaaaggggcggggaaaccgaaggacgggtaacgtacgaacgttaccgttacgtttacgtaccgg

SEQ ID NO: 332606 - DNA, 645 bp, Homo sapiens
  misc_feature: GZ8MTXP02IIMSB.8.34.D01.1.454.CMB.2.raw
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggagtcacgagagactcgtcgtgtgcagcctcgtggttcaccttnagtaactacggcatgcacgtgggtccccncaagcctaccgaggcaaaggggnttgggagtgggngctagtttgtttcagttcgtggagggctagttgttcagttggtatgacctagactcggtagaacgggccattaccactatccgtaccgagaacgtaactaacttacccgaagaaacctactaaagttggtttaagttagggactactacgaaactacgtaccttaaagtccaggaacgacgaacgggtactaaactacgtaaacgtacggtaaacgggaaacgggggtaggggaaaacccaaggggtaccgggtacgtttaacccgaaaggtttacccgtttacggtttacgacccggg

SEQ ID NO: 332607 - DNA, 625 bp, Homo sapiens
  misc_feature: GZ8MTXP02JQ4AX.8.34.D01.1.454.CMB.2.raw
  modified_base (300)..(300): a, c, t, g, unknown or other
  misc_feature (300)..(300): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagatgttggcgctacgtatcctggtaccaacagaaacctggccaggcctcccgacggcccctnatctatggtcgcactcccaacgacggggcccacgtcggaccactccccgagcctaggttcaggtcggcaggtggggtatggggacaggtaccttcactctacacctatccatcacgccgtggacgccgtaggaggtagtggttcgacttagttttacttacgttagtactaactagttaccgtaccggtaggtccggtcccggtccgggggtacctaccggtttcccgggacccgttacgggaaccgtaaacggtacggactaacgtaacgaaacgtaccgtaggtacggcgtaacggacctaccgtactcgtcgttctactacc

SEQ ID NO: 332608 - DNA, 692 bp, Homo sapiens
  misc_feature: GZ8MTXP02JAA19.8.34.D01.1.454.CMB.2.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (436)..(436): a, c, t, g, unknown or other
  misc_feature (436)..(436): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaangccacctctcctgcaggccagtcagaatgttggcncctagtatcctgtacaacagaaacctggccaggcctcccaggcccctcatctatggtncactcccgaacgacggggcccacgtggcccagtccccgagccgtaggttcaggtcggctaggtggggtatggggaccaggtcttcacgttctaccacctatccgatccagtccctgggacgccgttaggacggtnttggttacgtacgttaagttttacttacgttcggttaacctaaacgtacgtttaaccggtaccggtaaacgggtccggggtaccccggttacccggggggtcccttaaccggtttcccgggaccccgttaaggggaaaccccgtaaaagggtcgggtaaacttaacgtaaaccgtaaaaccggtaacgttcgggtacggtacgttaacggaccctaaccgtacgttccgtttacggttacctttaccgttaacccg

SEQ ID NO: 332609 - DNA, 609 bp, Homo sapiens
  misc_feature: GZ8MTXP02HV4UK.8.34.D01.1.454.CMB.2.raw
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (422)..(422): a, c, t, g, unknown or other
  misc_feature (422)..(422): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctcttgngcagcctgtggttccaccttnagtaactacggcatcgcacgtgggtcccncaagcctccgaggcaaggggnttgggaggtggggtgctaggttgtttcagtcgtgagggtctagttgttcagtgtatgcgagtcctcggtaggacggccgtattcaccgactctacagaanactaatacgaagaacacgtaaatgttagttaggacgtactacgaacgtacgaccgtaagtaccgtaggacggaacggtacggtacgtacgtactacggtacggaacgggtaacggggaacgggggaaaccgaacggggtaccggtaacggttcgaaaacggtttacccgtaccggtttacggaccgg

SEQ ID NO: 332610 - DNA, 641 bp, Homo sapiens
  misc_feature: GZ8MTXP02HVU1U.8.34.D01.1.454.CMB.2.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (398)..(398): a, c, t, g, unknown or other
  misc_feature (398)..(398): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgagggggaaanagccaccctctcctgcagggccagtcagatgtgcnctacgtatcctgtacaacagaacctggccagctccagccctnatctatggncatccaangggccactggcactcccagccaggttcaggtcggacaggtggtagtgggaacagtaccttcactctccaacatcatccagcccgagctcgaggntagttgtcggactttagttacttagtctaaacacgttacgtaccggtacggtcggtccggccccgggtaccggggtaccttaccgggtcccgggtacccgggttaaacggaaaaccggttaaacgggtacggtaaactaaaccgtaaaaccggtaaaacggttaccgttcggggttaccgtacgaacccggtaaccctaacgttacggtttaccgtttcgtttaacccgttacgtttaccccg

SEQ ID NO: 332611 - DNA, 666 bp, Homo sapiens
  misc_feature: GZ8MTXP02JGHYS.8.34.D01.1.454.CMB.2.raw
  modified_base (334)..(334): a, c, t, g, unknown or other
  misc_feature (334)..(334): n is a, c, g, or t
  modified_base (627)..(627): a, c, t, g, unknown or other
  misc_feature (627)..(627): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggaggcgtggtccagcctgggaggtcacagagactctcgtgtgcagcctcgtggttcaccttcagtaactacggcatcgcacgtcgggccgaccaagctcccgaggcgaaaggggtnttgggaggtgggtggcgtaggtttgtttccattcgtggagggctaggttcgttcgaagtggtatcgctaacggtaccgtaccggtaggaaacggggtccccgtaatttacccgaacctaacgtccgtacccgaaagtaacgtaaactaacgttaccgaaacgggaaactaaaccgtaaagttgttaatttacgggaacgtacgttacgaacgtacgtaccgttaacgtccgtaggacggacgtacgggacttactaccgtagtacggtaaacggaagggggacggggaaccgnggtacgggtacgtaccgaacggtttacctacgtttacgg

SEQ ID NO: 332612 - DNA, 612 bp, Homo sapiens
  misc_feature: GZ8MTXP02GDNFQ.8.34.D01.1.454.CMB.2.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (406)..(406): a, c, t, g, unknown or other
  misc_feature (406)..(406): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgtggcgcctacgtatctgtacaacagaaacctggccaggctcccgaggcccctnatctatggtncatccaacgacgggccacgtggaccactcccagcctaggttcaggtcggcagggtggatgggacaggcttcactctaccaccatcactcacgtcccgtggacnccgtaggagtattgttgacttagtttacttacgtgtacaacgtacgtacggtaccggagttccgggcccggttccggggcccttacggttcccggacccgtacgggaaccgtaaaaggtcggaactaacgtaaccgaaaacggtaccgttgggtaccgtacgtaacggacctaacctacgttccgttacgtcctttacgtaacccg

SEQ ID NO: 332613 - DNA, 582 bp, Homo sapiens
  misc_feature: GZ8MTXP02JDRCL.8.34.D01.1.454.CMB.2.raw
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (446)..(446): a, c, t, g, unknown or other
  misc_feature (446)..(446): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctcgtggttccaccttcagtaactacggcatgcacgtgggtcccncaagctccgaggcaagggntgggagtgggtgcgtagttgtttcagtcgtaggaggctagtgttacagtggtatgacagacgtcgtaggaacggctatcacatctacagaacgacaataccgaagaacactaatgttagttgganactagaacacgtacgtaacgtccgtagacgacgacgggtactatacgtacgtaggtaacggaaacgggggacgggggaaaccgaaggggtaccgggtacgttaccggaagttacccgttaccgttacggtaccggg

SEQ ID NO: 332614 - DNA, 542 bp, Homo sapiens
  misc_feature: GZ8MTXP02FZIYV.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggagtcacagagactctcgtgtgcagcctctgggttcaccttcagtaactacggcatgcactgggtccgccaagctccaggcaagggattgggagtggggtgcagttgttcatctgagggcagtgttcagtggtatgcagactccgtgaagggccgattcaccatctccagagacaattaccagaacacaatgtagtttggagctgaacagaccgtaagtcctaggacgacgacgggacgtatactacgtacggtacggaacgggaacgggggaacgaaggacggacgttaccgaagtactaccgtttagtaccgg

SEQ ID NO: 332615 - DNA, 548 bp, Homo sapiens
  misc_feature: GZ8MTXP02F7E4I.8.34.D01.1.454.CMB.2.raw
  modified_base (208)..(208): a, c, t, g, unknown or other
  misc_feature (208)..(208): n is a, c, g, or t
  modified_base (312)..(312): a, c, t, g, unknown or other
  misc_feature (312)..(312): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgtggcgctacgtatcctggtaccaacagaaactggccaggctcccaggcccctcatctatggtgcatccaacngggccacgtggcactcccagccaggttcagtcggcaggtgggtatggggacagaccttcactctcaccatcatcagcctggacgcttgaggatgttgctagtttattactgtaccaatctacgtacgagtcggccgtccgggggcctacgttccggccgtacgggaacctaaaggtcggataacgtaccgaaacgtacgtcggtacgcgtcgaccactactctcgttctactaccg

SEQ ID NO: 332616 - DNA, 703 bp, Homo sapiens
  misc_feature: GZ8MTXP02JEEM4.8.34.D01.1.454.CMB.2.raw
  modified_base (305)..(305): a, c, t, g, unknown or other
  misc_feature (305)..(305): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggaggcgtggtccagccgtgggaggtcacagagactctcgtgtgcagcctcgtgggttccaccttcagtaactacggcatgcacgtgggtcccncaagcctccgaggcgaaggggatttgggaggtgggtaggctaggtttgtttcagtcgtggagggctagttcgttcagtggtatgacagtaccgtcggaggaacgggccgtattccactatcctaccagacgaacaacttaccgaaggaaaccaacgtaagttacgttagtttagggacgtacgtaacgaaaccgtacgtaccgttaaacggtacccgttaagggaaacgggaacccggtaacggggttacgttaaacgttaaaccggtaaacggttaacggggttaaacggggaaaacgggggtaaccggggggtaaaacccgaacgggggtaaccggggtaacggtttaacccgtaaacggtttacccggttaccggttttaacggttaacccgggg

SEQ ID NO: 332617 - DNA, 577 bp, Homo sapiens
  misc_feature: GZ8MTXP02J1X3L.8.34.D01.1.454.CMB.2.raw
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtgggtccagcctggggaggtcacagagactctcgtgtgcagcctcgtgggttcaccttcagtaactacggcatgcactgggtccncaagctccaggcaagggnttgggagtggggtgctagtttgttcatctggagggcagtgttcaagttgggtatgacagactccgtggaaacgggccgattccacctatctaccagagacaattccagaacaacaatgtattggagctagaacagacctaagtccgtagaggacgacgggcgtaacgtacgtacgtaggtaacggaagggggacgggggaaccgagggaccgggtaagttaccgaacgtacgttaccgtttcggacggttcgtacgggg

SEQ ID NO: 332618 - DNA, 637 bp, Homo sapiens
  misc_feature: GZ8MTXP02HUS43.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtggtcaccttcagtaactacggcatgcacgtgggccaccaagcctccgaggcaaggggtattgggagtgggtggcgtagtttgttcagtcgtgaggctagttgttacagtggtatgacagtactcggtagaacggccgtattcacctatccgtaccagaacgtaacaacttaccgaaacggaaactaacgtaaattagttaagtttaggagtacgtagaaactacgtaaccctaacggtaccctaggacggaacgacggggtacgttacgtaaccgtacgtacggtaaaccgggaaacgggggaacgggggaaaccgaacgggtaccggggtaacgttacccgaaacggtttacccgtaccggttttacggtacccggg

SEQ ID NO: 332619 - DNA, 551 bp, Homo sapiens
  misc_feature: GZ8MTXP02FP4Q9.8.34.D01.1.454.CMB.2.raw
  modified_base (382)..(382): a, c, t, g, unknown or other
  misc_feature (382)..(382): n is a, c, g, or t
  modified_base (423)..(423): a, c, t, g, unknown or other
  misc_feature (423)..(423): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcgtgtgcagcctctgggttcaccttcagtaactacggcatgcacgtgggtcccgccaagcctccgaggcaaaggggattgggaggtgggtggctaggtttgtttcccattccgtggagggtcaggttnttcaatgggtatgcaagctccgtgaaggccgatcaccatcnccagagacaactcaaggaacanaatgtattgganctgaacngacctagtcctgagacgacggctacgtactactacgtaacgaggaacggggaacgaggacggacgtccgaacgtactacgtttacgg

SEQ ID NO: 332620 - DNA, 578 bp, Homo sapiens
  misc_feature: GZ8MTXP02IUO7C.8.34.D01.1.454.CMB.2.raw
  modified_base (454)..(454): a, c, t, g, unknown or other
  misc_feature (454)..(454): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtggggaggtcacagagactctcgtgtgcagcctctggttcaccttcaagtaactacggcatgcacgtgggtcccgccaagcctaccaggcgaagggattggaggtgggtgctaggtttgtttccagtcgtggaggctaggttgttcaagtggtatgcagactcgtagacggcctatcacatctaccagacgacatccaagaacacattagtattgganactagaactacgactaagtccgtaggagaccgacgggtacgtactacgtacgtacggtaacggaaggggaacgggggaaccgacgggacgggtacgttaccgaacgttaccgttacgttacggg

SEQ ID NO: 332621 - DNA, 536 bp, Homo sapiens
  misc_feature: GZ8MTXP02HF1XV.8.34.D01.1.454.CMB.2.raw
  modified_base (257)..(257): a, c, t, g, unknown or other
  misc_feature (257)..(257): n is a, c, g, or t
  modified_base (371)..(371): a, c, t, g, unknown or other
  misc_feature (371)..(371): n is a, c, g, or t
  modified_base (439)..(439): a, c, t, g, unknown or other
  misc_feature (439)..(439): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctntgggttcaccttcagtaactacggcatgcacgtgggtcccgcaagctccgaggcaagggattgggagtggggtgcagtttgttcatcgtgagggcaggtgttcaagttggatgnagactccgtgaaagggccgattcacatctcagagacaatacagacacaatgtatttggagactagaanagacctaagtacctgagacgacggcgtatactactagtacggaaaggacgggggaaccaggacggaagtacaagtactacgtcgacgtcgtacgggg

SEQ ID NO: 332622 - DNA, 547 bp, Homo sapiens
  misc_feature: GZ8MTXP02GFBO6.8.34.D01.1.454.CMB.2.raw
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (421)..(421): a, c, t, g, unknown or other
  misc_feature (421)..(421): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccagggggaaagagccaccctctcctgcagggccagtcagaatgttggcgcctacgtatcctggtaccaacagaaacctggccaggctcccaggcccctnatctatggtncatcccaanagggcccagtggcactcccagcctaggtcaggtcggcaggtgggtatggggacaggcttcactcacaccatcatcagcctgacgcctgagattcgtgctagtttnttactgtacaactagtcgtacggagtccggccgtccgggggcctaccgttcggccgtagggaacctaaggtcgatacgtacgaaacgaactggtacggctcgactactactcgttcgtcttactcc

SEQ ID NO: 332623 - DNA, 610 bp, Homo sapiens
  misc_feature: GZ8MTXP02HSZFO.8.34.D01.1.454.CMB.2.raw
  modified_base (417)..(417): a, c, t, g, unknown or other
  misc_feature (417)..(417): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacgagagactcgtcgtgtgcagcctcgtggtcaccttcagtaactacggcatgcacgtgggtcccaccaagcctaccgaggacgaaggggatttgggaggtggggtggcgtagtttgtttcatcgtggacgggctagttgttacagttgggtatgcgagtactcgtagacgggccgtatcacntcctacagaacgacaacttaccgaagaacaactattacgtttagttaggagacctagaacgacgtaacctaacgtaccgtaggacggaacgtacgggtacgttaagtacgttaacgtacggtacgggaaaacggggacgggggaacgaacgggtacggtacgttaccgtaagttaccgtcgtttacggaccgg

SEQ ID NO: 332624 - DNA, 753 bp, Homo sapiens
  misc_feature: GZ8MTXP02GR4O6.8.34.D01.1.454.CMB.2.raw
  modified_base (299)..(299): a, c, t, g, unknown or other
  misc_feature (299)..(299): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagcctctggttcaccttcagtaacctacggcatcgcactgggtcccnccaagcctccgaggcgaagggatttgggaggtggggtcggctaggtttgtttcagttcgtaggtagggctaggttcgtttacaagtttcgggtaatcggactaacggtaccgtttcccggggtaagggtaaaccggggtcccgtaacgtttacccaaccctaacgttacccgtacccgaaggtaacgtaaaccgtaaacgtttacccgaaaacgggtaaaacctaaaccgttaaagttacgtttaagttttagggaacggtaccgtaacgtaaaccgtacggtaaccgtaaacggttcccgtagggaaacggaccggtaacggggtaccgttaacgttaaccgtaacgttacgggtaaacggggaaaacggggaacggggggaaaccgaacggggtaccggggtaacggttacccggtaaacggttaccgtttaccggtttacggtaacccggg

SEQ ID NO: 332625 - DNA, 666 bp, Homo sapiens
  misc_feature: GZ8MTXP02IKL7M.8.34.D01.1.454.CMB.2.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctcgtggttcaccttcagtaactacggcatgcacgtgggtcccncaagcctccgaggcaagggnttgggagtgggtggctaggttgtttcagtcgtaggagggctaggttcgttacagttgggtatgctagctccgtaggaacggcgattcacgtatcctaccgagacgaacaacttacccaaggaaaccaactaaagtagtttaagtttagggacgtacgttagaaactacggtaacccttaaacggtcccgtagggaacgggaaaccgtaaccggggtaaccgtttaactaaaccgttacgtaacgggttaaccgggaaaagggggtaacggggggaaacccgaaggggtaccggggtaaacggttacccggaaacggtttaccgttacccgttttaggaacccgggg

SEQ ID NO: 332626 - DNA, 645 bp, Homo sapiens
  misc_feature: GZ8MTXP02F32CY.8.34.D01.1.454.CMB.2.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (401)..(401): a, c, t, g, unknown or other
  misc_feature (401)..(401): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttggctgaactgggttttcctcgttgcttcttttaagaggtgtccagtgtcaagtgcaacgtggtggagtcgtgggggagcgtggtccagccgtgggagtcacagagactctgtgtgcagcctgtggttcacttnagtaactacggcatgcacgtggggtccnccaagctccgaggcaaggggtnttagggaggtggggtagctaggtttgttcagtcgtggagggctagtgttacagtggtatgcagactcggagacggcatcacntctacagagactaataccaagaaacaacaattgttaagttggaacgtactaacgaaccgtacgaaccgttaacgtccgtaggaacgaaccggtaacggggtaccgttaaactaacccgttaaaccggtaaggttaaaccggggaaaacgggggaaaccggggggtaaaacctaacgggggacccggggtaaacggtttacccgggtaaacggtttaacccgtttccggtttacggtaacccggg

SEQ ID NO: 332627 - DNA, 611 bp, Homo sapiens
  misc_feature: GZ8MTXP02G9941.8.34.D01.1.454.CMB.2.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (367)..(367): a, c, t, g, unknown or other
  misc_feature (367)..(367): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgagggggaaanagcccaccctctcctgcagggccagtcagatgtgcnctagtntcctgacaanagaacctgccagctcccagcccctnatcagtggtncactccaaacgcgggccaacgtggaccacgtcccagccgtaggtcaggtcgcaggtgggtatcggggacngtcttcgactctcaccatcatcagtccgtggacgctaggacgtatgttgcttaagttttactacgtgttacaaacgttcgtaccggtaaccggtgtccgggtcccgggtacccgggggtcccttaaccggtttcccgggacccgtacggggaaaccctaaagggtcgggaaactacgtaaaccgaaaacgtaccgtggtcgtacgtaacgcctaaccctgttaccctacgttccttactacccg

SEQ ID NO: 332628 - DNA, 564 bp, Homo sapiens
  misc_feature: GZ8MTXP02IY8IF.8.34.D01.1.454.CMB.2.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtctgggggagcgtggtccagcctgggaggtcacagagactctcgtgtgcagcctctggtcaccttnagtaactacggcatgcactgggtccncaagctccaggcaagggnttgggagtgggtggctagttgtttcatctgagggcagtgttcagtgggtatgacagactccgtagaacgggccgtattcacatctccagagacaatccagaacacaatgtatttggagctagaacagacctaaagtcctaggacggacgacggggactaacgtacgtaacgtacggtaacggaaacggggacgggggaaaccgaaggaccggggtagttacccgaagttaaccttccgtttacggtaacccgg

SEQ ID NO: 332629 - DNA, 633 bp, Homo sapiens
  misc_feature: GZ8MTXP02IX9X2.8.34.D01.1.454.CMB.2.raw
  modified_base (273)..(273): a, c, t, g, unknown or other
  misc_feature (273)..(273): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgagctctgggagaggagcccagcactagaagtcggcggtgtttccattcggtgatcagcactgaacacagagactcaccatggagtttgggctgaacttgggttttcctcgttgcttcttttaagaggtgtccagtgtcaagtgcaacgtggtggagtcgtgggggaggcgtggtccagccgtgggaggtcacagagactctcgtgtgcagcctgtggttcacttnagtactcggcatgcacgtcgggtccgcaagctacccgaggcgaaagggnttagggaggtggggtggacgtagttgtttcagtcgtggaggggtctaggtgttacagttggtatgacagtctacgggtgaacgggcgtacttcgactatctacgagacgaactaactccgaagaaaccactaaagttgttagtttagggactacttaaggaaccgaacgtaccgttaaacgtccgtaagggaacggtacgtacggggtactaacgttaaccgtacggtaaggtaaccggggaaaagggggacgggggaaaccgaaggggtacggtaacgttaccgaaggttccgtttacgttacggtacgg

SEQ ID NO: 332630 - DNA, 623 bp, Homo sapiens
  misc_feature: GZ8MTXP02FWDAL.8.34.D01.1.454.CMB.2.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (416)..(416): a, c, t, g, unknown or other
  misc_feature (416)..(416): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanacgccaccctctcctgcagggccagtcagatgttgcgctagtatcctggtaccaacagaaacctggccaggcctcccaggccccctnatcctatggtncactccaacgagggcccacgtggaccattccagcctaggttccagtcggcaggtggtatgggacagtcttcactctacaccatcgatcagcctggacgcctagaaggtnttgttagtacttagtttacttacgtacgtaacaactacgttaccggtaaccggacggttccgggtcccggtacccggggtacccttaccggtttacccggacccggttacgggaaccgtaaacgggtacgtaaactaacgtaaacgaaacgtacgtacggtacgtacgtaacgacctacgtacttcgttacgttacctttactaccg

SEQ ID NO: 332631 - DNA, 597 bp, Homo sapiens
  misc_feature: GZ8MTXP02IKCXR.8.34.D01.1.454.CMB.2.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaagngccaccctctcctgcaggccagtcagatgttgcnctacgtatctggtaccaacagaacctggccaggcctcccaggcccctnatctagtggcncactccaacgacgggccacgtcggcactccccgagccctagggtcagtcggcaggtggtangggacagcttcactcncaccatcatcngcctggcncgtgaggtatgttcgacttagtttactacttgtacaacttagtccggtacggtacgtccggacccggtccgggggtaccctacggtttcccggacccgtacggggaaacctaacgggtacggtacgtaactaaccgaaaacggtacgtcggtaacggcgtaacggaccaaccgtagtactttcgttcctttacgtaccc

SEQ ID NO: 332632 - DNA, 669 bp, Homo sapiens
  misc_feature: GZ8MTXP02HYBMD.8.34.D01.1.454.CMB.2.raw
  modified_base (210)..(210): a, c, t, g, unknown or other
  misc_feature (210)..(210): n is a, c, g, or t
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanacgccaccctctcctgcgagggccagtcaagatggttggcgcctacgtatcctggtaaccaacagaacctggccaggcctcccgacggcccctnactctagtcggtgctatacccaacgacgggccaacgtggacactcccagccgtaggttcaggtcggacgtaggtgggtagtagggaccagtccttcactctaccactancaactcacgccgtagacgtcgtagtaggtagttggtagtacgttagtttacttacgttcgtaactaacgtacgtaccgtaacgggtacgtccggtcccggtacccgggggtaccttaccggtttccgggacccggttacggggaaaccccgtaaaggtacggtaactaaacgttaaaccgaaaacggtaacgtacgggttacggacgtaacggtacctaaccgtacgttaccgttccgttacctttaaccgtcccg

SEQ ID NO: 332633 - DNA, 525 bp, Homo sapiens
  misc_feature: GZ8MTXP02HUO8Y.8.34.D01.1.454.CMB.2.raw
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
  modified_base (512)..(512): a, c, t, g, unknown or other
  misc_feature (512)..(512): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggcctcccacggccccctcactctatggtgcatccaacagggccactggcatcccagccaggttcaggtcgcagtgggtatgggacagcttcactctccacatcatcagccctggacncctgaggatgttgctagtttatactgtcaactntacgtaccgagtcggccgtccggggccacgtttcggcctcgggacctaaggtgatactacgaaacgactgtcgctgcacntctcgtcttcacg

SEQ ID NO: 332634 - DNA, 643 bp, Homo sapiens
  misc_feature: GZ8MTXP02JD08A.8.34.D01.1.454.CMB.2.raw
  modified_base (301)..(301): a, c, t, g, unknown or other
  misc_feature (301)..(301): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacgagagactctcgtgtgcagcctctggttcaccttcagtaactacggcatcgcactcgggtccnccaagcctccgaggcgaaggggattgggaggtgggtggctagtttgtttcattcgtaggagggctaggttgttactagttggtaatggtacgagtacgtccggtaggaaacggggccgtacttccgacctagtccctaccagaacgaactaacgttaccaaggtaaaccaactaaagtgttaagtttggacgtactagaacacgtacctaagtccgtaggacggaacgacgggtacgttactaacgtacgtacggtaacgggaacgggggaacgggggaacccgaaggggaccgggtaacgttacccgaaaaggttaccgtttaccgtttacggtaaccggg

SEQ ID NO: 332635 - DNA, 685 bp, Homo sapiens
  misc_feature: GZ8MTXP02HG947.8.34.D01.1.454.CMB.2.raw
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagatgttgcgctagtatcctggtaccaacagaaacctggccaggcctcccacggccccctnactctagtggtcncactcccaaacgaggggccccaagtggacactcccgagccctaaggttcaggtcggactaggtgggtatggggacaggtacctttcgaacttcctaccaacctatccactacgacgtcccgtaggacgtccgtaggtaggtattggttcgacttaggttttaacttaccgttagtacctaactacgttaccggtaaccggtaggtcgggtccccgggtcccgggggtcccttaaccggtttcccggacccggttacggggaaaccctaaaagggtacgggtaaacttaaccgtaaacgtaaaaaccgtacgtacgggttacggacgttaacggacctaacccttacgtactttccggttccttttaccgtacccg

SEQ ID NO: 332636 - DNA, 703 bp, Homo sapiens
  misc_feature: GZ8MTXP02F74N9.8.34.D01.1.454.CMB.2.raw
  modified_base (270)..(270): a, c, t, g, unknown or other
  misc_feature (270)..(270): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagcctgggagtcacagagactctcgtgtgcagcctctggttcaccttnagtaactacggcatcgcacgtgggtcccnccaagcctccgaggcaagggnttgggagtggggtgctaggttgtttcacgttcgtggaggggctaggttcgttacgagttgggtaatggaccaaggtaccttccgggaggaaacggggtcccgtaattaccaacctattccctaccgaacggaacgtaacctaaacgttacccgaaagggaaaccaacctaaagtttcgttaagttttacgggaacgtacgttaacgaaaccgtacgtaacccgttaaacgtacccgtaggaacgggtaacgaccggggtacgttaaacgtaaccgttaacgtacgggtaaaccgggaaacgggggtaacgggggaaacccgaaggggtaccggggtaaacgttacccgtaaacggtttaccgttacccgtttaggtaacccgg

SEQ ID NO: 332637 - DNA, 671 bp, Homo sapiens
  misc_feature: GZ8MTXP02G34OC.8.34.D01.1.454.CMB.2.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctctggtcaccttcagtaactcggcatgcacgtgggtcccncaagctccgaggcaagggntggagtgggngctagttgttcatcgtggaggctagtgttacagtggtatgcgagtactcggtaggaaacgggtccgattaccacctatcctaccagaacgtactaaactaccgaaaggaactaactaagttagttaagtttaggaagtacttagaaaccgtacgtaaccgtaaacgtccgtaacgggaacggaaccggtaaccgggggtacgttaaacgtaaccgttacggttaaacgggtaaaccggggtaaaacgggggtaaccggggggaaaaccgttaaacggggaccggggttaaacggttacccgaaacgggtttacccgtttacccggtttacggttaacccggggg

SEQ ID NO: 332638 - DNA, 584 bp, Homo sapiens
  misc_feature: GZ8MTXP02G1HN2.8.34.D01.1.454.CMB.2.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (402)..(402): a, c, t, g, unknown or other
  misc_feature (402)..(402): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacagagactctcgtgtgcagcctctgggttcaccttcagtaactacggcatgcacgtgggtccnccaagctccgaggcaagggnttgggagtggggtgcgtagttgtttcatcgtggagggcaggtgttacagtgggtatgcaggctcgtagacgggcgatcaccntcctcagagacaactcagaaacacaatgtattggagtactagaacagacctaagtccgtaggacggacgacgggtaccgtaataccgtacgttacgggtaacggaaacgggggaacgggggaaaccgaaggggcggggtaacggttacccgaaaggttacctaccggtttacggtacccggg

SEQ ID NO: 332639 - DNA, 747 bp, Homo sapiens
  misc_feature: GZ8MTXP02HTBHU.8.34.D01.1.454.CMB.2.raw
  modified_base (275)..(275): a, c, t, g, unknown or other
  misc_feature (275)..(275): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtgggaggtcacagagactctcgtgtgcagcctcgtggtcaccttnagtaactacggcatcgcacgtcgggtcccgaccaacgcctaccgaggacgaaggggtatttggggaggttggggtggcgtaggtttgtttcagttcgtggaggggtctaggttcgttacaagttggttaatgactaacggtaccgtccggtagggaaacgggtcccgtaactttaccaacccgtattacccgttacccgaacggtaaacgtaaccgtaaacgtttacccgaaacgggaaaacctaacgtaaagtttacggtttaaagtttacgggaacgttaccgttaaacgaaaaccgtacgtaaccgttaaacggtcccgttaagggaacgggtaaccgtacggggtaccgttaaacgttaaccgtaacgttaacgggtaaacgggaaacgggggaacgggggtaaaccgaaggggtacggggtaaccgttacgtaaacggtttacccgttaccgttttacggtaccggg

SEQ ID NO: 332640 - DNA, 581 bp, Homo sapiens
  misc_feature: GZ8MTXP02JLIHN.8.34.D01.1.454.CMB.2.raw
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacgagagactctcgtgtgcagcctgtggttcaccttcagtaacctacggcatgcacgtgggtccncaagctccgaggcaagggnttgggagtggggtgctagttgttcactcgtggaggctagtgttacagttggtatgcagtacgtcgtaggaacggccgattcaccatctaccagacgacaattccgaagaacactaatacgttattggagactagacacgtacctaacgtccgtagacgacgtacgggtacgtagtaaccgtacgtacggtaacggaacggggacgggggaaccgaacgggacgggtacgtaccgtaacgtaccgttaccgttacggtaccgg

SEQ ID NO: 332641 - DNA, 596 bp, Homo sapiens
  misc_feature: GZ8MTXP02GRSKH.8.34.D01.1.454.CMB.2.raw
  modified_base (238)..(238): a, c, t, g, unknown or other
  misc_feature (238)..(238): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagccgtgggagtcanagagactctcgtgtgcagcctgtggttccaccttcagtaacgtacggcatcgcacgtcgggtcccacgaagcctaccgaggcgaagggattgggaggtgggtgcgtagttgtttacattcgtagggctagtgttacaagttggtatgactagacgtcggtagacggccgtattccacgtatcctacagacgactaataccgaagaacaatatagtattagagtactagaactagacctaaagtccgtagaggtaaccgacgggtactaataccgtagttagggaacggaaacggggaacggggaaccgaggaaccgggtattaccgtaacgtaccgttaccgttacggacgttccggg

SEQ ID NO: 332642 - DNA, 699 bp, Homo sapiens
  misc_feature: GZ8MTXP02HLM88.8.34.D01.1.454.CMB.2.raw
  modified_base (209)..(209): a, c, t, g, unknown or other
  misc_feature (209)..(209): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttgcgcctagtatcctggtaccaacagaacctggccaggcctcccacggcccctcatctatggtgcactacccaacgacgggcccaacgtcggaccactccccgaagccccgtaaggtttccaaggtccgggaccgagggttcggggtaattgggggacaggtacctttcgaactcctaccacctatcatcacgccgtaggacgccgttaggaggtattggttcgtacgttaacgtttatttaccgttacggttacaaacgttacgttaccggtaccggtaacgggttccgggtccccgggttcccggggggacccctttaaccggttttccccgggggtaccccgttacgggggtaaacccgtaaaacgggttacgggaacttaaacgtaaccggtaaaaccgtaaacgtcggttacggccgttaacggacacctactcgttcgttcctttactacc

SEQ ID NO: 332643 - DNA, 539 bp, Homo sapiens
  misc_feature: GZ8MTXP02GPGF9.8.34.D01.1.454.CMB.2.raw
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
  modified_base (408)..(408): a, c, t, g, unknown or other
  misc_feature (408)..(408): n is a, c, g, or t
  modified_base (442)..(442): a, c, t, g, unknown or other
  misc_feature (442)..(442): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctgggaggtcacagagactctcgtgtgcagcctctggtccaccttcagtaactacggcatgcacgtcgggtcccnccaagcctccgaggcgaaaggggnttgggaggttggggtgctaggtttgtttcattcgtggagggctagtgttacagtggtatgcagctcgtagaggccatcacatcncagagacaactacgagaacacaatgtagttggantagaacacgactacgtcctagagacgacggactatactacgacgtaacggaacgggacggggaacaaggacggtacgtacgagtacgtcgtgtacgg

SEQ ID NO: 332644 - DNA, 677 bp, Homo sapiens
  misc_feature: GZ8MTXP02GC7KO.8.34.D01.1.454.CMB.2.raw
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (659)..(659): a, c, t, g, unknown or other
  misc_feature (659)..(659): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagacgcccaccctctcctgcagggccagtcagatgtggcnctagtatcctgaccaanagaacctggcaggcctcccgacgcccctnatctagtggtncactacccgaacgcgggccacgtggacctacgtccccaaggccctaggggttccaggtcggaccgtagggttggggtacgtaggggaaccaggttaccttccaccttcctaccaacctatacccaattaccgacgtcccgtagggaccgtacccgttaggggacggtacgtttggttacggtactttaaggttttaacttacgttcgtaactaacgtacgttacggtaccggtaggtcccgggtcccggttacccgggggaccttaccggtttccgggacccgttacggggaacccgttaaggggcggaagtaccgtaacgaaacggtacgtcggtcgacgtcgactaaccctntccgttctcgttctaccg

SEQ ID NO: 332645 - DNA, 529 bp, Homo sapiens
  misc_feature: GZ8MTXP02FSRKZ.8.34.D01.1.454.CMB.2.raw
  modified_base (156)..(156): a, c, t, g, unknown or other
  misc_feature (156)..(156): n is a, c, g, or t
  modified_base (270)..(270): a, c, t, g, unknown or other
  misc_feature (270)..(270): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttggctgaacttgggttttccncgttgcttcttttaagaggtgtccagtgtcaagtgcaactggtggagtcgtgggggagcgtggtccagccgtgggagtcacgagagactctcgtgtgcagcctctggtcacttnagtactcggcatgcacgtgggtcccacaagcctaccgaggtcgaagggtattgggaggtggggtgctagttgttcagtctgaggcagtgttnagtgatgcngactcgngaggcatcacatcacaganacatacagacanatgtattcgagctagacagcctaatccgtagacgacgacggtagtatactacgtagaaccggaagggacggggaacaagggacggaacgttaccgaagttaccgtaccgttaggtaccgg

SEQ ID NO: 332646 - DNA, 569 bp, Homo sapiens
  misc_feature: GZ8MTXP02I8ZHL.8.34.D01.1.454.CMB.2.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctctgggttcaccttcagtaactacggcatgcacgtgggtccnccaagctccgaggcaagggntgggagtggggtgctagttgttcatcgtgaggcagttgttcagtggtatgcagactcggtagaacggctatcacatctacagagacaactaccagaaacacaatgttagttaggagtactagaacacgaccgtaacgtccgtaggacggacgacgggtacgtaacgtactaacgtacggtacggaaacggggacgggggaaaccgaagggacgggtaacgtaccgtaacgtaccgttccgtttaggtaccgg

SEQ ID NO: 332647 - DNA, 556 bp, Homo sapiens
  misc_feature: GZ8MTXP02F2XY8.8.34.D01.1.454.CMB.2.raw
  modified_base (363)..(363): a, c, t, g, unknown or other
  misc_feature (363)..(363): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagcctcgtggttcaccttcagtaactacggcatgccacgtggtccgtcaagcctcgaggacgaagggtattgggagtggggtgcgtagttgttcagtctggaggcagtnttacagtgtatgcagactcgtgaagcagttcacatctaccagacgacattaccagaaacacatgtagttacgagtctagaacacgtacctaaagtcagtacggacgacgggtacgtaatacgtacgtaggtaacggaaacggggacggggaacgaaggacggtacgtaccgtaagtcctaccgttagtaccgg

SEQ ID NO: 332648 - DNA, 568 bp, Homo sapiens
  misc_feature: GZ8MTXP02HLL6V.8.34.D01.1.454.CMB.2.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (439)..(439): a, c, t, g, unknown or other
  misc_feature (439)..(439): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagcctgtggtcaccttnagtactacggcatgcacgtgggtcccncaagcctccaggcaagggntttgggagtgggtgctagttgttcatcgtgaggctagtgttacagtggtatgcagtactcggtagaacgggcgattcgactatcctaccagagacaactacaagaacacaatgttattgganactagaacagtactaacgtcctagacgtaacgacggtaccgtaataccgtagtacggtaacggaacggggacgggggtaaaccaaggggacggtacgttaccgaaggttacccgtcgtttacggaccgg

SEQ ID NO: 332649 - DNA, 711 bp, Homo sapiens
  misc_feature: GZ8MTXP02JREBH.8.34.D01.1.454.CMB.2.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtgggttccaccttcagtaactacggcatgcacgtgggtcccncaagctccgaggacaagggnttgggagtggggtggctagtttgttcagtcgtggaggggtctaggttgttacaagttggtatgacacggtaccttccgggtagggaaaccgggtcccgtaattacccaccgtaactccgtaccgacgaacgaacctaaacgttacccgaaaggtaaacctaacgttaaagttaggtttaagtttacgggaacgtacgttacggaaaccgtacgtaccgttaacggtacccgtaggtaacggaacgtaaccgggtaacgttaacgtaacgttaaccgtagggtaaaaccgggaaacgggggtaaccgggggaaaccgtacggggtaccggggtaaactttaccggtaaacgttacccgtttaccgtttacggtaccggttcggtaccggggg

SEQ ID NO: 332650 - DNA, 792 bp, Homo sapiens
  misc_feature: GZ8MTXP02FLJ5Q.8.34.D01.1.454.CMB.2.raw
  modified_base (297)..(297): a, c, t, g, unknown or other
  misc_feature (297)..(297): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctcgtggttcaccttcagtaactacggcatgcactgggtccnccaagctccaggcaagggattgggagtggggtggctaggttgttcagtctaggaggggctaggttgttacgaaagttggggttatgacgtaagtaccgttaccgggtaggaaacgggggtcccgtaacgtttacccaaaccctaattcccgtacccgtaacggtaaacggaaacctaaacgtttaacccccgaaagggaaaaccctaaacctaaagtttaggtttaaagtttttacggggaagtaccgttaacggtaaaaccgaaccggtaaccccgtttaaaacggtaccccgtttacgggaaacgggaacccggtaaccgggggtaaccgtttaaaacgttaaccgttaaacggttaacggggttaaaaccggggaaaagggggaaaccgggggggtaaaaccgacgggggtaaccgggggtaacggtttaaccccggtaaaggtttacccgttaccggtttacgggtaaccggttccggtttacccgggggg

SEQ ID NO: 332651 - DNA, 611 bp, Homo sapiens
  misc_feature: GZ8MTXP02JUKAV.8.34.D01.1.454.CMB.2.raw
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatggttggcgctacgtatcctggtaccaacagaaacctggccaggctcccgaggccccctnatctatggtcncatccaanggggccaagtggcctccacgcagttcgagnggccagtgggtagtgggacnggacttcgactctcaccatcacgtcagctcggagccgtaggagattggtgactagtttattacgtagtcaaactactcgtaccgtacggtcggtcccggtaccgggggtccctacggtttccgggccccggttacgggaacccggtaaaagttacggggactaacgttaacgaaaacccgtaaacggttgcggtccgtaaggccgaaaccctgtacggttcgtaccttaacgtacctttccccg

SEQ ID NO: 332652 - DNA, 652 bp, Homo sapiens
  misc_feature: GZ8MTXP02FZ0O6.8.34.D01.1.454.CMB.2.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaanacgccaccctctcctgcagggccagtcagatgtggcncctagtntctgaccaanagaacngccagctccgacgcccctnatctatggtgcactaccgaacgacgggccacgtggacctactccccgaagcccgtaggttcaggtcggacgtaggtgggtagtgggacagtcttcactctaccactatacatacgacgtcccgtaggacgccgtagggaagctttggttacgtattaacgtttattacgtcgtaaccaacgttacgttaccggtaaccggtaggttcccgggtcccggtcccgggggtaccttaccggttcccgggacccggttacggggaaaacccgtaaaggtacggtaaacttaacgtaaaccggtaaaacggtaccgtaggtcggtacgtaacgaccgacctacgttccgttacgtacctttacgtacccg

SEQ ID NO: 332653 - DNA, 683 bp, Homo sapiens
  misc_feature: GZ8MTXP02GSE6W.8.34.D01.1.454.CMB.2.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtggggagtcacagagactctcgtgtgcagcctcgtggttccaccttnagtaactcggcatgcacgtcgggcccncaagcctacgaggacgaaggnttgggaggtgggtgctagtttgttcagttcgtggagggtctaggtgtttacaagttggtatcgacaacggtaccttcccgggtagggaaaccggggtcccgtacttacccgaccctactacccgtacccgaagaaacgtaaccgtaaaccgttaccgaaacggaaacctaacctaaagttagttaagtttacggaacgtacgttacggaaaccacgtaacccgttaagtcccgtaaggacggaaccgtacggggtacttaacgtacgtacgtaacgggtaaaccggaaaggggacgggggaaccgagggaccggtaacgttaccgaacgttaccgttcgttacgaccggttcggtacccggg

SEQ ID NO: 332654 - DNA, 554 bp, Homo sapiens
  misc_feature: GZ8MTXP02FHN78.8.34.D01.1.454.CMB.2.raw
  modified_base (531)..(531): a, c, t, g, unknown or other
  misc_feature (531)..(531): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggcctccccacggccccctcatctatggtgcactcccaacacggggcccacgtggccactccccgagcccaggtttcaggtcggcaggtgggtatggggacagtctcactctcaccatcatcagcctggacgccgtgaggattgttgtcgtagtttattacgtgtacaactatacgtaccgagtcggcccgtccgggggcctacgttccggcccgtagggacccaaagtcggatactacaaacgacgtcgngctcgcacactctcgtcttctac

SEQ ID NO: 332655 - DNA, 630 bp, Homo sapiens
  misc_feature: GZ8MTXP02JYONS.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtggttcaccttcagtaactacggcatgcacgtgggtcccaccaagctccgaggcaaggggtattgggaggttggggtggctaggtttgtttcattcgtggagggctaggttgttacaagttgggtactgggactaggtacctccgggtaggaaacggggcccgtaacttccaacctacgttcctacccgaagaacgaacctaaacttacccgaaaggtaaaccaactaaagttgttaagtttggagtactagaacacgtaccgtaacgtccgtagacggacgacgggacgtacgtacgtacgtacggtacggaaaggggacggggaccgaggacggtaacgtaccgaacgtactcgttacgacgtcgtcggg

SEQ ID NO: 332656 - DNA, 705 bp, Homo sapiens
  misc_feature: GZ8MTXP02FX9KM.8.34.D01.1.454.CMB.2.raw
  modified_base (324)..(324): a, c, t, g, unknown or other
  misc_feature (324)..(324): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctgggagtcacagagactctcgtgtgcagtcctcgtggttcaccttcagtaactacggcatgcacgtcgggtcccaccaagcctccgaggacgaaggggnttgggagtggggtgcgtagtttgttacatcgtggagggtctagttgttacaagttggtatgctagtccgtaccggtaggaacgggccgtacttaccacctactacctaccgagtacaactaacttaccgaacgaaacctaacgtaaagttgttaaagtttacgggaacgtaccgttaacggaaaccgtaaccgtaaccgttaaacggtacccgtaagggaaccgggaaccgtacggggtacgttaaacgttaccgttaacgtaacgggtaaacgggaaacgggggtaaccggggggaaaccgacggggtaccggggtaaccggttaaccgtaaacggttacccgtttccgtttacgggaccggttacgggtaacccggggg

SEQ ID NO: 332657 - DNA, 642 bp, Homo sapiens
  misc_feature: GZ8MTXP02GX04N.8.34.D01.1.454.CMB.2.raw
  modified_base (171)..(171): a, c, t, g, unknown or other
  misc_feature (171)..(171): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtggtccagcctgggagtcacagagactctcgtgtgcagcctcgtgggttcaccttnagtaactacggcatgcacgtgggtccncaagctccgaggcaagggnttggagtgggngctagttgttcatccgtgaggcagtgtcaagtgggtatgacagtacctccggtagaacgggccgattccgacctaatcctacccgaagacgaactaaacgttacccgaaggaaacaaacgtaaagttacgttagttttagggagtacgttaggaaacctacggtacccttaaaggtcccgtaggaacggaccgacggggtacgttaacgtaacgtaccgtagggtaaaccggaaagggggaacgggggaacccgagggaacggggtaacgttaccgaaacggttaccgttaccgtttacggacggtttaccgggg

SEQ ID NO: 332658 - DNA, 663 bp, Homo sapiens
  misc_feature: GZ8MTXP02FY3HT.8.34.D01.1.454.CMB.2.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaanacgccaccctctcctgccaggccagtcagatgtgcnctagtatcctggacaacagaaacctgccaggcctcccgacggccccctnactctagtggtcnctactaccaacgacgggccacgtcggacacgtcccgagccctaggttccaggtcggacgtaggtcgggtagttcggggacctagggtccttacacttctaccacctatctattaccgacgtccgtggaacgtccctaggtaaggtagttacgttgtaccgttaagttttacttacgttcgtaacacgtagttaccgtaccggtagtccggacccggtccgggggccttacgttccggaccgtacgggtaaacctaaaggttcggaactacgtaaccgtaaaccggtaacgttcggtcggtacccgttaagacccgttaccctaaggttccgttacgtttaacccttcggttaacccc

SEQ ID NO: 332659 - DNA, 714 bp, Homo sapiens
  misc_feature: GZ8MTXP02IXMJB.8.34.D01.1.454.CMB.2.raw
  modified_base (312)..(312): a, c, t, g, unknown or other
  misc_feature (312)..(312): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagcccaccctctcctgcagggccagtcagatgttggcgctagtatcctggtaccaacagaaacctggccaggcctcccgacggccccctcatctagtggtcnctactcccgaaacgacggggcccaacgtcggacctaactccccgagccccgtaaggttccaggtccggacgtagggttggggtagtcggggaacaggtacctttcaacttctaccacctatccactccacgccctgggacgccgttaggaggtagttgtacggtcttaaaggtttcttaacgttcggtaactaaacgttacgttaccgggtaccggtagggttcccggtccccggggttaccgggggacccctttacggtttccccgggggaccccgttacgggggaaaaccccgtaaaagggttcgggaaacttaaccgtaaaccgtaaaaaccggtacgttacgggtcgggtaacctcggacctaaaccctcgttacctccgtttaccttaccttacccg

SEQ ID NO: 332660 - DNA, 685 bp, Homo sapiens
  misc_feature: GZ8MTXP02GIW1W.8.34.D01.1.454.CMB.2.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagttttcagataccaccggagagattgtgttgacacaatctccagccaccctgtcttcgtctccaggggaaanagccaccctctcctgcagggccagtcagatgttggcnctacgtatcctggtaccaanagaaacctggccaggctccccaggcccccctacatctagtggtcacctactacccgaacgacgggacctacgtcggaccaccgtccccgacggtccgtagggttccaggtccggaccgtaggggttacgggtagcgggaactaggtaccttcacttcctaccaacctatcaacgtccgacgtccgtacggacggtaccgtaggacggtagttcggttacgtacgttacgttttacgttacgttacgttaactaacgtacgttaccgtaccggtacggtccgggtacccggtcccgggggtaccgttaccggttcccgggtaccggtacgggaaccgtaacggtacggtaagtaacgtaacgtaaacgtacgtacggtcgtacgtaacgtacctactacgttcgtcgttaccttctaccg

SEQ ID NO: 332661 - DNA, 626 bp, Homo sapiens
  misc_feature: GZ8MTXP02GX698.8.34.D01.1.454.CMB.2.raw
  modified_base (180)..(180): a, c, t, g, unknown or other
  misc_feature (180)..(180): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtggtccaggccgtgggagtcacagagactctcgtgtgcagcctctgggttcaccttcagtaactacggcatgcacgtgggtcccncaagcctccgaggcaagggnttgggaggtgggtgcgtagttgtttcatcgtgaggctaggtgttacagtgggtatgacagactccggtaggaacgggccgtattcgaaccatcctaccgagacgaactaacttaccgaaggtaaacactaaagttgttaagtttggactctaaggaacacgtactaaacgttccgaggaacgacgtaacgggtcgtaaatacgtaacgtacggtaacgggaaagggggacgggggaaacccgaagggtaacggggtaacgttaccgaaacgttaccgttaccgttacggtaacccggg

SEQ ID NO: 332662 - DNA, 684 bp, Homo sapiens
  misc_feature: GZ8MTXP02JPY7C.8.34.D01.1.454.CMB.2.raw
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtgggggaggcgtggtccagcctgggaggtcacagagactctcgtgtgcagcctcgtggttcaccttnagtaactacggcatgcacgtggtcccgcaagctaccgaggcaagggnttggaggtggggtgctagtttgttcagtctggagggctaggttgttcaaagttgggtatcgcgagtaccgtccggtagggaaacgggtccgtaacttcccgaacctactccgtaccaagaacgaacctaaacgttaccccgaaaggaaacctaacgtaaagttagttaaacgtttagggaacgtcgttaacgggaaacctaacggtacccgttaaagtcccgttagggaaccggaccggtaacgggacgttaacgtaaccgttacgtacgggtaaacggggaacggggaacgggggaaaccgacggggacgggtaacgttaccgtaaacggttccgttaccgtttacggaccggttcggtaccgggg

SEQ ID NO: 332663 - DNA, 562 bp, Homo sapiens
  misc_feature: GZ8MTXP02F5OMF.8.34.D01.1.454.CMB.2.raw
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttgcgcctacgtatcctggtaccaacagaaacctggccaggcctcccacggccccctnactctatggtgcatcccaacnggggcccacgtggccactcccgagcccaggttccagtcggcaggtgggtatggggaccagtctcactctcaccatcatcagccctggancctagagnttgttgcgtagtttacttactgtaccaacattaccgtacgagtcggacccgtccgggggacctacgttccggcccgtacgggaaccgtaaagtcggatacgtacaaaacgtacgtcggtgactgacaccacgttcctgtctactac

SEQ ID NO: 332664 - DNA, 736 bp, Homo sapiens
  misc_feature: GZ8MTXP02JTYGN.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggaggcgtggtccagccgtgggagtcacagagactctcgtgtgcagcctcgtggttcacttcagtaactacggcatgcacgtcgggtccaccgaagcctccgagggtaccgaaggggtagttggggaggttggggtcggtaccgtaggttttcgtttacccgagttccgtagggacggggtctaggttgttcgtaaagttgggtaatgaccgtaaggtaccttccgggtagaaaccgggccgtacgtaccaccgtacttaccgacccgaagaacgtaacctaaccttaaccggaaacggtaaaccaaacgtaagttagttaagtttacgggaatactaacgaaaccgtacggtaacctaaacggttcccgtaagggaacggtaaccggaacggggtaaccgttaaacgtaaaccgttaaccggttaacggtaaaaccgggggtaagggggaacgggggtaaaaccaaggggtaccgggtaacggtaccgtaaacgttccgtttacggtttaacggg

SEQ ID NO: 332665 - DNA, 617 bp, Homo sapiens
  misc_feature: GZ8MTXP02GQSOL.8.34.D01.1.454.CMB.2.raw
  modified_base (413)..(413): a, c, t, g, unknown or other
  misc_feature (413)..(413): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgttggcgcctacgtatcctggtaccaacagaaacctggccaggcctcccgacggccccctcatcctagtggtgcactcccaaacgacgggcccacgtcggacctactccccgaagccctaagggttccaggtcggctaggtgggtatggggacagtccttcgactctacaccntcatcagtccgtggacgccgtagaggtattcggttgacgttagtttattacgtgtaccaactagtccggtaccgagtcggcccggtccgggggaccttacggtttccggacccgtacggggaaccctaaaggtcggaattacgtaaccgaaacgtaacgtcggaggtacaagtaccaacgtactcctacgttcctttactaccg

SEQ ID NO: 332666 - DNA, 608 bp, Homo sapiens
  misc_feature: GZ8MTXP02JTODX.8.34.D01.1.454.CMB.2.raw
  modified_base (315)..(315): a, c, t, g, unknown or other
  misc_feature (315)..(315): n is a, c, g, or t
  modified_base (338)..(338): a, c, t, g, unknown or other
  misc_feature (338)..(338): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggagcgtggtccaggccgtggggagtcacgagagactctcggtgtgcacgcccttcgtggggttccacccttcaagtaaacctacggcatgcacgtcgggtcccncaaagcctccgaggcgaagggtntgggaggtgggtggctaggtttgtcatccgtggagggctaggtgtacaagtggtatgcagctcggagacggctatcacntcncagacactatcagacanatgtattgancgtanaacgcgactaacgttccgaggacggaaccgacggggtactaaagtccgtaaaggtacggaaacgggaacgggggaaacgggggaaaccgaggggtcggggtaaaccgttaccggaaaacgtttccggttaccggtttacggacggtttacccgggg

SEQ ID NO: 332667 - DNA, 650 bp, Homo sapiens
  misc_feature: GZ8MTXP02HF2RN.8.34.D01.1.454.CMB.2.raw
  modified_base (258)..(258): a, c, t, g, unknown or other
  misc_feature (258)..(258): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggagtcacagagactctcgtgtgcagcctntggtcaccttcagtaactacggcatcgcacgtgggtcccaccaaggcctaccgaggaccgaaaggggtattgggaggtggggtggctaggttttggttcagttccgtaggacggggctaggttgttacaagttgggtatcgcgagaccgttccggagaaacgggccgtattacccgaacctacgtaccttcccgaagtacgaactaaacttcccgaaacggtaaccaaacgtaaagttagttagtttacggagtacgtaacgaaactacggacctaaacgttccgaggtacggacgtaacggtacgtaactacgtacgtaggtaaacggacggggaacggggacagggaacggtagtaccgtaacgttaccgtacgtttacggacgtacggg

SEQ ID NO: 332668 - DNA, 745 bp, Homo sapiens
  misc_feature: GZ8MTXP02GYPCM.8.34.D01.1.454.CMB.2.raw
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacgagagactctcgtgtgcagcctcgtggtcaccttcagtactacggcatgcacgtgggtcccnccaagctaccgaggcgaagggnttgggaggtggggtggctaggtttgtttcagttcgtggacgggctaggttgttacagttggtaatggactaacggtaccgttacccgggtagggaaacggggtcccgtaattacccgaaccctactcccgtacccgaaggaacgaaacctaaacgttaccccgaaagggtaaaccctaacgtaaagtttacggttaaagtttgggaacgtaccgttaaacggaaaccgtaccggtaacccgttaaacggtcccgttaacgggaacgggtaacccggtaaccgggggttaacttaacgttaaccggtaaacgtaacggggtaaaaccggggaaacgggggaacgggggaaaacccgaacggggaccgggtaacgttacccgaaaaggtttcccgttaccggtttacggtaacccggg

SEQ ID NO: 332669 - DNA, 610 bp, Homo sapiens
  misc_feature: GZ8MTXP02F4XM7.8.34.D01.1.454.CMB.2.raw
  modified_base (300)..(300): a, c, t, g, unknown or other
  misc_feature (300)..(300): n is a, c, g, or t
  modified_base (420)..(420): a, c, t, g, unknown or other
  misc_feature (420)..(420): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcagggccagtcagaatgtggcgcctagtatcctggtaccaacagaaacctggccaggcctcccgacggccccctnactctatggtcgcactaccaacgacggggcccaacgtcggaccactccccaaggccctaggttcaggtcggcaggtggggtatgggacagtcttcactctcaccatcatcagcctggacnccgtggagattgtgcttagtttattactgtacaactacgtcgtaccggtagtccggccggtcccgggggtcctaccggtttccggacccgttagggggaacctaaagggtcggaacttaacgtaaccgaaaacggtacgttaggtacgtaccgtcggacctacctacttccgtacgttaccttactaccc

SEQ ID NO: 332670 - DNA, 693 bp, Homo sapiens
  misc_feature: GZ8MTXP02JUMS3.8.34.D01.1.454.CMB.2.raw
  modified_base (300)..(300): a, c, t, g, unknown or other
  misc_feature (300)..(300): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctcgtggttcaccttcagtaactacggcatcgcacgtgggtcccnccaagcctccgaggcaagggnttggaggtgggtggctaggttgtttcatcgtggaggctaggttgttacgaagttggtatggactacggtaccgtccggtagggaaacgggtccgtacgttaccgaccctaacgtcctacccgaaaggtacgaaacctaacttacccgaagggaaacctaactaaagttagtttaacgtttagggaagtacgtaaggaaactaacgtacccgttaaacggtcccgtaggaacggaccgtaacgggacgttaacgtaaccgttaaccgtaggggtaaaccggaaagggggaacgggggaaaacccgacggggaacgggtaacgtacccgtaaacggttacccgttaccgttacggtaacggttcggtaccgggg

SEQ ID NO: 332671 - DNA, 607 bp, Homo sapiens
  misc_feature: GZ8MTXP02J1UO7.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccaggcctggggaggtcacagagactctcgtgtgcagcctctggttcaccttcagtaactacggcatgctacgtgggtcccaccaagcctaccgaggcgaaggggtattgggaggtggggtggctaggttgttcatcgtggagggctaggtgttacagtggtaatgacagactccggtaggaacggtcgattccactctctcagacgaacaattcccgaaagaaccataagtgtattaggacgtactagaacgtacgacctaaacgtccgtaggaaggacgtacggggtatactaaccgtacgtacggtaacggaaagggggaacgggggaacaacggggtacgggtacgttaccgtaaacggtaccgtttaccgttacggtaccgg

SEQ ID NO: 332672 - DNA, 364 bp, Homo sapiens
  misc_feature: GZ8MTXP02FHWBO.8.34.D01.1.454.CMB.2.raw
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagctcgcgtgtccacgaccggtgctcgatttagatcgtctgtgttggcgcctacgtatcctggtaccaacagaacctggccaggctcccaggcccctcatctatggtgcatccaacagggccactggcatcccagccaggttcagtggcagtgggtatgggacagacttcactctcaccatcatcagcctgagcctgaggatgtgcagtttatactgtcaacntcgtaccgagtggcctccgggtccacttcggcccgnggaccaagtaggatatcaaacgaactgtggctgcaccatctgtcttcatcctccgtcccatctgagaccacgcgagctgagcgggcgtgcaaggcgctntagn

SEQ ID NO: 332673 - DNA, 571 bp, Homo sapiens
  misc_feature: GZ8MTXP02ICZ5X.8.34.D01.1.454.CMB.2.raw
  modified_base (211)..(211): a, c, t, g, unknown or other
  misc_feature (211)..(211): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgagggggaaanagccaccctctcctgcagggccagtcagaatgttggcgctagtatcctggtaccaanagaacctggccagccncccagcccctnatctatggtcncatccaacgnggccagtggcatcccagccaggttcagtcgcgaagtgggtatggggaccagtacttcgactctacaccatcaatccagccgtggacgccgtgaggtatgttgacgttagtttacttaactgttacaaacgtactcggtaccgaggttccggccgtaccgggggtcctacggtttccgcccggtagggaaccgtaaaggtcggagtactacgaaaaccgtactaggtggactcgacactacgtctcgttctactcc

SEQ ID NO: 332674 - DNA, 736 bp, Homo sapiens
  misc_feature: GZ8MTXP02HYNHN.8.34.D01.1.454.CMB.2.raw
  modified_base (171)..(171): a, c, t, g, unknown or other
  misc_feature (171)..(171): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtggtccagccgtgggagtcacagagactctcgtgtgcagcctctggttcaccttcagtaactacggcatgcacgtgggtcccnccaagctccgaggcaagggnttgggngtggggtggctaggtttgtttcagttcgtggaggggtcaggttgttacaagttgggtatggacctaaggtacccgttccgggtagggaaacgggggtccccgtaacgtttaccacccgtactcccgtacccgaaagtaacgaaccgtaaactttaaccccgaaaggtaaaaccaactaaaagttacggtttaagtttacggggaagtccgtagaaaccgtaaccgtacccgttaaacggtcccgttaaggacgggtaaccgaccgggggtaccgttaacgttaaccgtaaccgttacggggtaaaccggggaaacgggggaacggggggtaaacccgtaagggggaccggggtaacggttaccgtaaacggttaccgttaccggtttcggtaaccggttcgggttaccggggg

SEQ ID NO: 332675 - DNA, 702 bp, Homo sapiens
  misc_feature: GZ8MTXP02G179K.8.34.D01.1.454.CMB.2.raw
  modified_base (281)..(281): a, c, t, g, unknown or other
  misc_feature (281)..(281): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggagtcacagagactctcgtgtgcagcctcgtggtcaccttgagtaactcggnatgcacgtcgggtccacaagcctaccgaggacaaggggtntcgggagtcggggtgctaggttcgtttcacgttcggtagagggtctaggttcgttacgagttcgggtatcggacgacgtaccgtccggtagggaaacgggtccaacgttccaccgtactcgtacccgagacgtaaacgtaacttcccgaaaggtaaaccagttaaagttggttagttacgggacgttacgtaacggaaacctacggtaccgtttaaacggtccgtacgggaaacggaacccggtacgggtaccgttaaagttaaaccccggtaggttaaccgggtaaccggggaaaagggggtaccgggggaaaaccctaagggggtacccgggtaacgtttacccgaaaggtttacccttaccggtttacggacccgggg

SEQ ID NO: 332676 - DNA, 619 bp, Homo sapiens
  misc_feature: GZ8MTXP02I05LR.8.34.D01.1.454.CMB.2.raw
  modified_base (174)..(174): a, c, t, g, unknown or other
  misc_feature (174)..(174): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaacgtggtggagtcgtgggggagcgtggtccagccgtgggagtcacagagcctctcgtgtgcagcctntgggttcaccttcagtactcggcatcgcacgtgggtccncaagctccgaggcaagggtnttgggaggtggggtgctaggtttgttcatcgtgagggctagtgttacagttgtatgacagtcgtcggtaggaacgggtccgtattccgacctatccgtaccagaacgactaacttccgaagaaacacgtaattgttagttggagtactagaacacgtaccgtaacgttccgtagacggacgtacgggtacgtaaacgtacgtaacgttacggtaacgggaaacggggtacgggggaaccgtaaggggaccgggtacgttacccgaacgtttaaaaccgttccggtttacgtaaccgggg

SEQ ID NO: 332677 - DNA, 612 bp, Homo sapiens
  misc_feature: GZ8MTXP02JUQ0I.8.34.D01.1.454.CMB.2.raw
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (373)..(373): a, c, t, g, unknown or other
  misc_feature (373)..(373): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctntgggttcaccttcagtaactacggcatgcacgtgggtcccncaagctccgaggcaagggnttggagtgggtgctagtttgttcagtctggagggcagtgttcaagttggtatcggnaacgtaccgtccgtaggaaacgggcccgtattccacctatccgtacgagacgactaacgttaccgaacggaacaactaagtgttaagtttggagtccgtaggaaactcgtaaccgtaagttacccgaggacgacggacggcgttaactaacgtacgtagggtaacggaaacggggacgggggaacacgggacgggtaacgtacgtaacggtaccttacgtttacggacgtcgtacgggg

SEQ ID NO: 332678 - DNA, 714 bp, Homo sapiens
  misc_feature: GZ8MTXP02JHR0A.8.34.D01.1.454.CMB.2.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagccctgtgggttcaccttcagtaactacggcatgcacgtggccncaagctccaggcaaggnttggaggtgggtgctagttgtttcattcgtggagggcaggttgtacaagttgggtactgctaaggtacctccgggtagaaaccgggggtccctaacttaccaaccctaattccctaccgaagtaacgaacctaaacgttacccgaaaggtaaaaccaactaaagttggttaaagtttacgggagtaccgttagggaaaaccaacggtaacccgtttaaaacggtcccgttaagggaacgggaacccggtacggggtaaccgttaaagttaacccgtagtaccggggttaaaccggaaagggggaacgggggtaaacccggaagggtaaccggggtaaccggtaaccgttaaaacggttccgttaacccggtttcggtaaccggttaccggtacccgggggg

SEQ ID NO: 332679 - DNA, 565 bp, Homo sapiens
  misc_feature: GZ8MTXP02JABQB.8.34.D01.1.454.CMB.2.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaaggggaaagcgccacctctcctgcaggccagtcagatgtggcnctagtntcngtacaanagaaccngcagctccagcccnatctangncatccaanggccangcactccanccagtcagtcgcaggtggagtgggacagcttcactcacacctatcatcagcctggacgctgagtntgttgcttaagtttattactgtacaactacgtccggtaacggaggtccggccggtcccgggggtacctacggttcccgggacccgtaggggaaccctaaaagggttcggaaacttaacgaaaccgtaaaacggtacgtcggtacggtacctcggacccaaccgtacttccgtcgttaccttactaccg

SEQ ID NO: 332680 - DNA, 606 bp, Homo sapiens
  misc_feature: GZ8MTXP02IPGVA.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtgggttccaccttcagtaactacggcatgcacgtgggtccgccaagcctccgaggcaaggggtatttgggagttggggtggctaggtttgtttccattcgtggagggtctaggttgttcaaagttgggtatcggcagtaccgtccggtagaacgggccgtattcacctatctaccagaacgacaactccaaggaaacactaatgttattggacgctagaacagacctaagtcctaggaacggacgacgggtacgtactaacgtacgtacggtaacggaaggggaacgggggaaccgagggacgggtacgtaccgtaacggttaccgttacgtttacgg

SEQ ID NO: 332681 - DNA, 694 bp, Homo sapiens
  misc_feature: GZ8MTXP02IEPAF.8.34.D01.1.454.CMB.2.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtggttcaccttnagtaacctaggcatcgcactcgggcccnccaagctccgaaggcaagggnttgggagtgggtggcagtttgttcatcgtgagggctagtgttacaagttgtatgacagacctccgtaggaacgggccgattcgacctagtctacccgaagtacgaactaacttaccgaagggaaaccaacgaaagttagttagttttacgggaagtaccgttaggaaaccgacggtacccgttaaaacggtccgttacgggaacgggtaaccgtaaccgggggtacgttaacttaaaccggttacgtacgggttaaaaccgggggaaaaggggaccggggggtaaaacccgaagggggaccggggtaacggtttacccgtaaaacggtttacccggttaccggtttacggtaacccggttcggttaacccgggggg

SEQ ID NO: 332682 - DNA, 662 bp, Homo sapiens
  misc_feature: GZ8MTXP02FUFE8.8.34.D01.1.454.CMB.2.raw
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggnggagtcgtgggggaggcgtggtccagccgtgggaggtcacagagactctcgtgngcagcctctgggttcaccttcagtaactacggcatgcacgtggggtcccnccaagcctccgaggcaaggggattgggaggtggggtggctaggttgtttcagtcgtggagggcagtgttcaagttgggtatgacagtactccggtaggaacgggccgtattcacctactcctaccgagacgacaaacttaccgaacggaaacactaaagttagttaagtttagggacgtaccgtaggaaaccgtaacgaccccttaaagtcccgtagggacgggtaacgacggggtacgtaacgttaacgtaacgttacgggtaaacgggaaacgggggaacggggggaaacccgaggggtacgggaacgttaacccggaacggttaccgttcgttacggaccggttacggtaccggggg

SEQ ID NO: 332683 - DNA, 600 bp, Homo sapiens
  misc_feature: GZ8MTXP02ILG66.8.34.D01.1.454.CMB.2.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
  modified_base (461)..(461): a, c, t, g, unknown or other
  misc_feature (461)..(461): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaangcccaccctctcctgcagggccagtcagatgtgcnctacgtatcngacacagaactgcagcnccacgcccncntctatggtgcactccaacgacggccacgtcgaatccgtaccanccgtaggtcaggtccgactggggtcgtaggtcgggaacngggtacctcgaccttcaccactcgactactcacgtcccgtaggccgtcgtaggaacgttgtttaggtctagtttaagtttacttacgttgtaaccngtaaacctcgttaccgggtacgtacggggtccgtccgggtccgggtaccgttcggtacccgtacgggacgaacggtaggacgtaggtacaaacttcgtaacgaacgtgtaacggacctctactccctagttcctactac

SEQ ID NO: 332684 - DNA, 636 bp, Homo sapiens
  misc_feature: GZ8MTXP02FMKIJ.8.34.D01.1.454.CMB.2.raw
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (448)..(448): a, c, t, g, unknown or other
  misc_feature (448)..(448): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagacgccaccctctcctgcagggccagtcagatgttggcncctagtatctggaccaanagaacctgccagcctcccagccccnatctatggtncactcccaacgacgggcccacgtggaccactccccgagcccgtaggttccaggtcggacgtaggtggggtatggggacagtcttcactctaccactatcatcacgcctggacgccgtagagagttgtcgtgttaagtttagttactntacaacgtagtacgtacggtaggtcggtcccggttccgggggccttaccggtttcccgggaccggttacgggaaacccgtaaaaggtacggtaaacgttaaacgaaccgtaaaacggtaaacgttcgggacggttacctaaggtacccgaaacctacgtttaccttacggttcctttaccgttaaccg

SEQ ID NO: 332685 - DNA, 707 bp, Homo sapiens
  misc_feature: GZ8MTXP02IBZ1J.8.34.D01.1.454.CMB.2.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagcgccaccctctcctgcgagggccagtcagaatggttggcgctacgtatccgtaggtaaccaanacgaaacctggccaggcctacccgacggcccctnaactctagtggtcacactacccaaacgcgggacccacgtggacctaacctcccgaagccccgtaagggttccaggttccggactagggtggggtagtgggacagtcttcgaactccgtaccacatcaactcagtccgtggacgtctaggacggtattcggttacgtacgttagtttttaaactacgttaggtaaccaaaacgtttcgtacccggtaaccgggtacgttcgggtaccccgggttcccgggggtacccttaacggtttccccggggacccgttaggggaaaacccctaaaggttcgggtaaactaaacgttaaaccggaaaaacgtccgttgggaacggtcctaacggaaccctaacgttacgtaccgtttcgttaaccctttccgtaacccg

SEQ ID NO: 332686 - DNA, 738 bp, Homo sapiens
  misc_feature: GZ8MTXP02HDCEG.8.34.D01.1.454.CMB.2.raw
  modified_base (209)..(209): a, c, t, g, unknown or other
  misc_feature (209)..(209): n is a, c, g, or t
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccacggagagattgtgttgacacaatctccagcccaccctgtcttcgtctccgaggggaanacgcccaccctctcctgccagggccagtcagatgttggcgctagtatctggtaccaanacgaacctgaccaggcctcccacggcccctnactctagtggncagtaccaacgcggccctaacgtcggccacgtcccgaggaccctaggttccgaggtcggctagggtggggtagtcggggtaacacggtaccttcaaccttccgtaccaacctataccactccgagtcccgtaggaccggtctagggaacggtatttgggttacggtacctttaaagttttaacgtttaccttacggttaaaccaaacgggtttacgttaccccgggtacgggtacgggttaccccggggtcccccggggttaccggggggtaccccctttaacggttttcccccgggggaccggtaaacgggggtaaaaccctaaaagggttcccgggtaaatttaaccggtaaaacgaaaaccggtcgttaaggttccggaactaaccggactaacccgtagttcccgtcgttacccttaacgtcccg

SEQ ID NO: 332687 - DNA, 638 bp, Homo sapiens
  misc_feature: GZ8MTXP02HML0X.8.34.D01.1.454.CMB.2.raw
  modified_base (269)..(269): a, c, t, g, unknown or other
  misc_feature (269)..(269): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggccagcctgggagtcacagagactctcgtgtgcagcctgtggttcaccttnagtaactacggcatcgcacgtcgggtcccacaagcctccgaggcaagggtattgggagtggggtgcgtagtttgttcagtcgtggacgggtctaggtttcgttacaagttgggtactgacacgtaccgtccggtaggaaacgggtcccgtattaccaccgtactcctaccgaagtacgaacctaacgttacccgaaacggaaaccaacgtaaagttgttaagtttagggacgtctaggaaactacgtaccgtaagtcccgtagacggtacgacgggactaacgtacgtacgtaggaacggtaaacggggacggggaacctagggacggtaagtaccgaacgttacctacgttacgaccgtcggtacggg

SEQ ID NO: 332688 - DNA, 624 bp, Homo sapiens
  misc_feature: GZ8MTXP02H0BP6.8.34.D01.1.454.CMB.2.raw
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccacctgtcttcgtctccaggggaaanagccaccctctcctgcagggccagtcagaatgttggcgctacgtatctggtaccaacagaaacctggccaggctcccagcccctnatctagtggncactaccaaacgacggccagtggacactcccagccgtaggtcaggtcggacgtaggtgggtatgggacagtccttcactcacaacatcatcacgcgtaggacgccgtagaggtatgttcgacttagtttacttacgtcgtaactaaacgtacgtaccggtaccggtacggtccgggtccccggtcccgggggtaccctacccggtttcccggacccggtacggggaaaccgtaaaacgggtacggtaactaacgtaaacgaaaaccgtaacgtcggtacggccgtaacgaccaaccgtactccgttcgttaccttactaccg

SEQ ID NO: 332689 - DNA, 610 bp, Homo sapiens
  misc_feature: GZ8MTXP02I3PJ2.8.34.D01.1.454.CMB.2.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctcgtgggttcaccttcagtaactacggcatgcacgtgggcccncaagctccgaggcaagggnttgggagtgggtggctagttgtttcatctggagggcagtgttcaagttggtatgcagacctccggtgaaacgggtccattcacctagtcctaccaagacgactaaacttcccgaaaggaaaccactaaagttgttaatttagggagtcctaggaaaccacgtacctaagtccctaggacggacgaacgggacgtacgtactaacgtacggtaaggaaacggggaacgggggaaaccgacggacggggtaacgtaccgaacgttacgtaccgtttcggtacggtcgtaccggggg

SEQ ID NO: 332690 - DNA, 795 bp, Homo sapiens
  misc_feature: GZ8MTXP02G3TNY.8.34.D01.1.454.CMB.2.raw
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgaggggaaagagccacctctcctgcaggccagtcagatgtgcnctagtatctgtacaacagaacngcaggctcccgaggcccctnatctatggtgcatcccaacgacggggcccaacgtggaccacgtccccagccctaggttccaaggtcggcgtaggttggggtagttcggggacaacggtcctttccaacgttcctaccaacccatccactaccacgacccgttagggacgcccgttaggacgggtattggtttacgtaccgtttaaggttttaactttaacgttacggttaacctaaaaccgttagttacccgggttaacccgggtaacggggttacccggggtcccccggggtttaccccggggggggtacccctttaaccccggggttttcccgggggtaccccccggtttaacggggggtaaaacccccgttaaaaacgggggtttccggggtaaaacgtttaacccggtaaaaccgttaaaaaccccggggtaaacgttaaccggggtttccgggaaccgttaaccgggaacccgtaacccttaaacgtttcccgtttacggtttaccccgtttacgtttaacccccg

SEQ ID NO: 332691 - DNA, 701 bp, Homo sapiens
  misc_feature: GZ8MTXP02IDV1A.8.34.D01.1.454.CMB.2.raw
  modified_base (325)..(325): a, c, t, g, unknown or other
  misc_feature (325)..(325): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtgggtggagtcgtgggggaggcgtggtccagccgtgggaggtcacgagagactcgtcgtgtgcagcctcgtggtcaccttcagtactcgcatgcacgtgggtcccacgaagcctccgaggcgaagggngttgggaggtggggtgtcgtaggtttgttacagtcgtagggacgggctaggtttcgttacgtaggttgggttaatcggaccgtaacggtacccgtaccggtagggaaccggggtccgtacttaccgacctactccgtaccgaagtaacgaactaacgttaccgaaggaaaccaactaagttaggtttaagtttaggacgtaccgtagaaacctacggtaccgttaacggttccgtagggaaccgggtaacgtaaccggggtacgttaacgtaaccgttaacggtaaacggggtaacgggaaacgggggtaacggggaaaccggaacgggtacgggtacgttaccgtaacggtttaccgtacggtttacggaccggg

SEQ ID NO: 332692 - DNA, 682 bp, Homo sapiens
  misc_feature: GZ8MTXP02FMTPC.8.34.D01.1.454.CMB.2.raw
  modified_base (272)..(272): a, c, t, g, unknown or other
  misc_feature (272)..(272): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagcctgggagtcacagagactctcgtgtgcagcctcgtgggttcaccttnagtaactacggcatgcacgtcgggtcccgccaagcctaccgaggacaagggattgggaggtggggtgctaggtttgttacatcgtaggagggtcaggttgttacaaagttggtatgactaacggtaccgttccgggtaggaaacggggtcccgtaaacgttcccaaccctacttaccgtacccaaaggtaacgaaccttaaacttaaccccgaaggaaaacctaactaaagttaggttaaagtttacgggagtacctaagggaaacctacgtaaccgtaacgtcccgtagggaacggaacgacggggtacgtaacgttacttaacgtacggtaaacgggaacggggacgggggaaacacggtacgggtaacgtacgaacgttacctcgtttacggacggtcgtaccgggg

SEQ ID NO: 332693 - DNA, 755 bp, Homo sapiens
  misc_feature: GZ8MTXP02F3GND.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcgagggccagtcagaatgttggcgctacgtatcctggtaccaaacgagaaaccgtcggccaggcctcccgacggcccctcatccgtatggtcgctatacccgaacgacggggcctaacgtcggaccactccccgagaccccgtagggtttccgagggtcggaccgtaagggttggggtaacgtcggggaaacctagggtacccttccgaccttacctaccaaccctatccaaattccgacggtcccgtaggggtaacgcccgttagggaacggtagttcgggtttcggtaacttaaggtttttaacttaacgttacggtaacctaaacgttacgttcccggtaaaaccgggtcggttaccggggtccccggggttcccgggggtacccctttaacgggtttccccggaccccgggttacggggtaaaacccgtaaaagggttcgggtaaattaaccgaaacggtaaaaccggtaactttcgggaccgtacgtcggaccaaccgtacgttcgtcgtttaccttctaacccg

SEQ ID NO: 332694 - DNA, 691 bp, Homo sapiens
  misc_feature: GZ8MTXP02IRU14.8.34.D01.1.454.CMB.2.raw
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccaggccgtggggagtcacgagagactctcgtgtgcagcctgtggtcacttnagtactacgnatgcacgtcgggtccaccaagcctaccgaggcgaaaggggtnttgggaggttggggtcggctaggttcgtttcacgttcgtggacggggtctaggttcgttacagttggtatgacagtacgtccgggtaggaaacggggcctattaccgaacctattacccgtaccgaagaaacgtaacctaaacgttacccgaaacggtaaacctaaacgtaaagttacgtttaagtttagggaacgtaccgtaagaaaccgtacggtaaccgttaaaacggtccgtaagggaacgggaccggtaacggggtacgttaaacgtaacgttacgtacgggtaaccgggaaaagggggtacgggggaaaccgaagggaccgggtagttaccgaacgttaccgttacgtttacggtaccgg

SEQ ID NO: 332695 - DNA, 714 bp, Homo sapiens
  misc_feature: GZ8MTXP02JVC6L.8.34.D01.1.454.CMB.2.raw
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtgggggagcgtggtccagcctgggagtcacagagactctcgtgtgcagcctctgggttccaccttcagtaactacggcatgcacgtgggtcccgccaagcctccgaggcaagggnttgggagtggggtgcgtagtttgtttcagtcgtggagggctaggttgttacaagttgggtatggactagtacctccggtaggaaacgggcccgtagttaccaaccgtactccgtacccaagacgaaccaaacttacccgaaagggaaaccaaactaaagttggttaaagttttacggggaagtacgttacggaaaaccgtacgtaaccccgttaaacggttacccgttagggaacgggtaaccggaaacgggggtacgttaaacgttaaccgttaacgtacgggtaaaccgggaaaagggggtaaaccggggggaaaccgaacggggtacggggtaacggttacccggtaaacggttacccgttaccggtttacggaccggttccggtaccggggg

SEQ ID NO: 332696 - DNA, 711 bp, Homo sapiens
  misc_feature: GZ8MTXP02JJ6MD.8.34.D01.1.454.CMB.2.raw
  modified_base (273)..(273): a, c, t, g, unknown or other
  misc_feature (273)..(273): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctcgtgggttcaccttnagtaactacggcatgcacgtgggtcccacaagcctccgaggcaagggnttggaggtggggtgctagttgttcagtcaggagggcagtggttacaagttgggtatgacaggtacctcggtaggaaacgggtccgtaacttcgaaccctatcctaccaaggaacaacctaaacgtttacccgaagggaaaaccaaacgtaaagttaggttaaagtttcgggaacgtccgttaagggaaaacctaagtacccgtaaacggttcccgtaaggaacgggtaaaccgaacggggtaccgttaaacgtaacccgttaaacggttacggtaaaaccgggtaaagggggaaccgggggtaaaacccgacggggaccggggtaaacgttacccggaaaacggtttacccgttacccggtttacggacccgggttcggttacccggggg

SEQ ID NO: 332697 - DNA, 568 bp, Homo sapiens
  misc_feature: GZ8MTXP02IV8JB.8.34.D01.1.454.CMB.2.raw
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggtttcctcgttgctctttaagaggtgtccagtgtcaagtgcaactggtggagtcgtgggggagcgtggtccagcctgggaggtcacagagactctcgtgtgcagcctntggtcaccttcagtactacggcatgcacgtgggtccncaagctccgaggcaagggnttgggagtgggtgctagttgttcatcgtgagggcaggttgttcagtggtatgacagtactcggtaggaacgggcctagttcacgatcctacgagacgacaacttaccaaggaacactaagtagttattaggagtactagaacagtacctaaagtcctagacgacgacgggtcgtactacgtacgtacgtaacggaagggtacgggggaaccaaggacgggtacgttaccgaaggtaccgttacgttacggtaccgg

SEQ ID NO: 332698 - DNA, 605 bp, Homo sapiens
  misc_feature: GZ8MTXP02HCIT1.8.34.D01.1.454.CMB.2.raw
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacagagactctcctgtgcagcctctgggttcaccttcagtaactacggcatgcacgtgggtccncaagctccaggcaagggnttgggagtgggngctagttgttcatcgtgagggcagtgttacagtggtatgcagtactcggtaggaacgggcctagttcaccgatcctaccagacgaactaacttacccgaaggaaaccacgtaaattgttatttagggacgtactagaaacgacgaccgtaacgtccgtaggacggacgtaaccgggacgtaagtacgtacgtacggtaacgggaaacggggaacgggggaaaccgaagggacgggtaacggttaccgaaacgtaccgttccgttacggtacccgg

SEQ ID NO: 332699 - DNA, 681 bp, Homo sapiens
  misc_feature: GZ8MTXP02JG27U.8.34.D01.1.454.CMB.2.raw
  modified_base (209)..(209): a, c, t, g, unknown or other
  misc_feature (209)..(209): n is a, c, g, or t
  modified_base (250)..(250): a, c, t, g, unknown or other
  misc_feature (250)..(250): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccgagggaaagngccaccctctcctgcaggccagtcagaatgtggcgctagtntctggtacaacagaactgccagcctccacgccctnatctagtggcncactaccgaacgacgggccaacgtcggacactcccgacgccgtaggtcaggtcgggactaggggttaggggtagtcggggaactacgtaccgttcaaccttcctaccaacctattacactacaccggtcccgtagggaccgtaccgttagggaaggttacgttggttacgtacgtttaaagttttactttacgtcgttaaaccaaacgttacggttaccggtaaaccgggtgggttcccggggtaaccccggttcccggggggtaccttaccgggtttccccgggacccggtaacgggaaaccgtaaaggtcggtaaataccgtaaacggaaaacgtacgtacggtcgacctcgacctactacgtctcgtttacctacttacccg

SEQ ID NO: 332700 - DNA, 699 bp, Homo sapiens
  misc_feature: GZ8MTXP02JXZMF.8.34.D01.1.454.CMB.2.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactntcgtgtgcagcctntggttcaccttcagtaactacggcatgcacgtgggtccnccaagcctaccgaggacgaaaggggatttgggaggtggggtggtctaggtttcgtttcagtcgtggagggctaggttgttacagttgggtaatggacaagaccgttccggtaggaacggggtcctaacttaccaccatccctaccgaacgaagaactaaacttacccgaaggaaaaccaactaaagttggttaagtttagggaacgtacgttaacgaaacgaacggtaaccccgttaaaggtacccgttagggaacggtaaccggaaccggggtacgttaaacgtaaccgttaaaccggttagggtaaaacggggaaacgggggaaacggggggaaaccgaacggggtacgggtaacggtttaccgaaaacggtttaccttaccggtttacgtaaccgggg

SEQ ID NO: 332701 - DNA, 734 bp, Homo sapiens
  misc_feature: GZ8MTXP02GW7LV.8.34.D01.1.454.CMB.2.raw
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctgtggtcacttcagtactcgcatgcacgtgggccncaagctcgaggcaagggnttgggagtgggtggctagttgtttcagttcgtggagggtctaggttgttacgagttgggtaatggactaacggtaccgttccgggtagggaaacgggggtccctaacgtttacccgaacccgtattcccgtacccgaaggtaacggtaaacctaaacgttacccgaaacgggtaaaacctaaccgtaaagttacgggtttaagtttagggaaacgtaccgttacggaaaaccgtaacgtacccgttaaaacggtccccgtaagggaacggggtaacccgtaacgggggtacttaaacggttaaccgttaacggtaacgggttaacggggaaaacgggggtaacgggggaaacccgtaaggggtaccgggggtaacgtttacccggaaacggtttacccgtttccggtttacggtaacccgggg

SEQ ID NO: 332702 - DNA, 761 bp, Homo sapiens
  misc_feature: GZ8MTXP02JX3NG.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggagcgtggtccagccgtgggagtcacagagactcgtcgtgtgcagcctctggttccaccttcagtaactacggcatcgcacgtcgggtcccaccgaagtcctccgaggaccgaaaggggtattgggaggttggggtcggtcgtaggtttgtttccagttcgtaggacggggtctaggtttgttcgaaagttgggtattggaccgtaaggtacccgttcccggttagggaaacggggtcccgtaactttaccgaccctaacgttaccgtacccgaacggaacgtaaccttaaacgttaccccgaaagggaaaccctaaacgtaaaagttcgttaaacgttttagggacgtaccgttacggaaacctaacggtacccgttaaaacgttccgtaaggtaaccgggtaacggtaccggggtacgttaaacgtaaacgttaccgtaacgggtaaaccgggtaaagggggaaaccggggggaaacccgtaacgggggtaccgggtaacggttacccgtaacggttacccgtttaccggtttaccgg

SEQ ID NO: 332703 - DNA, 723 bp, Homo sapiens
  misc_feature: GZ8MTXP02F3WD0.8.34.D01.1.454.CMB.2.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (425)..(425): a, c, t, g, unknown or other
  misc_feature (425)..(425): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagcgccaccctctcctgcagggccagtcagatgttgcncctagtntcctgtaccaacagaactggcaggcctcccgaggcccctgactctagtggcacactacccaaacgcggggacctaacgtggaccacgtcccccgaagtccccaggggtttccaaggtccggactagggttaggggtaagtcggggaaactaggtacctttcgaacctttacncccaaacctacttcgaacttaccgaacggtcccgttagggaaccggtcccttagggaaacgggtttagtttacggttacgtacgtttaaagttttacgtttaaccgtacgtaaacctaaacgttacgttaccggaaccggtacggtccgggcccggtacccggggtaccctttaccggttcccggaccggtaacgggaaccgtaaaggtacggtaactaacgtaaaccgtaaaacggtacgtacggtacggtacgtaaccggtacctaacgtacttcgttacgttacttaccgtaccg

SEQ ID NO: 332704 - DNA, 654 bp, Homo sapiens
  misc_feature: GZ8MTXP02GHKDV.8.34.D01.1.454.CMB.2.raw
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaagtggtggagtcgtgggggagcgtggtccagcctggggagtcacagagactctcgtgtgcagcctntggtcaccttcagtaactacggcatgcacgtgggtcccnccaagcctaccaggacaagggtattgggaggtggggtgctagttgttcatcgtgagggctagtgttacagtgatgacagactccggtagacggcgtatcgacatctacagagaactaactaccgaaggaaacaactaaagttgttaagtttgggaacggtacttaacggaaactaacggtacccttaaacggtcccgtaagggaacgggaaccggacggggtaaccgttaagtaaaccgtaccgtaagggtaaaccgggaaaacgggggaaccggggggaaaaccgaacgggggtaaccggggtaacggttacccggaaacggtttaccgtttaccggtttaacggtaacccgggg

SEQ ID NO: 332705 - DNA, 670 bp, Homo sapiens
  misc_feature: GZ8MTXP02GHO6B.8.34.D01.1.454.CMB.2.raw
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgcccaccctctcctgcagggccagtcagaatgttggcgcctacgtatcctggtaccaacagaaacctggccaggcctcccgaggcccctnatctatggtncatcccaacgacggggccacgtggccactcccgagccgtaggttcaggtcggcaggtgggtatggggacagtcttcactctacaccatcatccagtcccgtggacgccgttaggaggtattggttacggcttagtttacttacgttggtacctaaactacgttaccggtaaccggtcggtccggggtccccgggttacccgggggtcccttaacccgggttttcccggggaccccggttacgggggaaaacccctaaaaggggttcgggaacttaaacgtaaaccgaaaacggtaaccgtgggtacggaccgttaaggaccctaaccgtacgttccttacggtttaccttacgttcccg

SEQ ID NO: 332706 - DNA, 692 bp, Homo sapiens
  misc_feature: GZ8MTXP02HLB07.8.34.D01.1.454.CMB.2.raw
  modified_base (342)..(342): a, c, t, g, unknown or other
  misc_feature (342)..(342): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccaggccgtgggaggtcacagagtactcgtcgtgtgcacgcctcgtggtccaccttcagtaactcggcatcgctacgttcgggcccacaacgcctaccgaggacgaaggggtntttggggaggtggggtcgcttaggtttcgtttacagtcgtaggacggtctaggttgttacgagttcggtatcgacaggtactcgggtaagggacggcctaattccaaccgtctccgacagtaacgaacctaacgtaccgaagaaacctaacgtaagttaggttagttcggacgtacgttagaaacgtacgtaaccttaaacggtccgtaaggaacggtaaccggtacggtacgttaacgttaaccgtaacgttaacgggtaacgggaaaacggggaacgggggaaccgtaaggggtacccgggtaacgttaaccggaacgtttaccgtttccggtttacggtacccgggg

SEQ ID NO: 332707 - DNA, 625 bp, Homo sapiens
  misc_feature: GZ8MTXP02FLAE0.8.34.D01.1.454.CMB.2.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacagagactctcgtgtgcagcctntggttcaccttcagtaactacggcatgcacgtggtccnccaagctccgaggcgaagggnttgggagtggggtggcgtagtttgtttcagttcgnggagggtcagtgttacgaagtggtngcacgtacgtcccggtaggaaacggggcctagttaccacctactctacccaagtacgaacctaacgttacccgaaaggaaaccactaaagttgttagtttacggagtacctagaaacacgtacctaacgtcgtaggaacggacgtacgggacttacgtacgtagtacggtaaacggaaggggaacgggggaccgaggacggtaacgtaccgtaacgttacgttaccgttacgacggtcggtacgggg

SEQ ID NO: 332708 - DNA, 642 bp, Homo sapiens
  misc_feature: GZ8MTXP02I3FWK.8.34.D01.1.454.CMB.2.raw
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctgtggtcacttcagtaactcggcatgcacgtgggtccnccgaagcctccgaggcaaagggtnttgggagtggggtggctagtttgtttcagttcgtggagggtctagttgttcagttggtatgacagactcggagaacggggcctagtccaaccgatctaccgagacgaactaacgttaccaaggaaaaccaactaaagttagttaagtttgggacgtacgtaacgaacctacgtaccgtaaacgttcccgtaggaacggtaaccgtacggggtacgttaaactaacgttacgttacgggtaacggaaacgggggaacgggggtaaacgaacgggtacggggtaacgttaccggtaaacgttaccggttaccgtttacggtaaccgg

SEQ ID NO: 332709 - DNA, 697 bp, Homo sapiens
  misc_feature: GZ8MTXP02HVYII.8.34.D01.1.454.CMB.2.raw
  modified_base (304)..(304): a, c, t, g, unknown or other
  misc_feature (304)..(304): n is a, c, g, or t
  modified_base (327)..(327): a, c, t, g, unknown or other
  misc_feature (327)..(327): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactgggtggagtcgtgggggaggcgtggtccagcctggggagtcacagagactctcgtgtgcacgccctctggggttccaccttcagtaactacggcatgcactgggtcccnccaaggcctccgaggcaagggtntggaggtgggtgctagtttgttcatcccgtggaggcagttgttcaagtggtatgcagtacctccggagtaacggggcctagtaccaccgtaatcctaccgagtacgaactaaacttaccgaacggtaaacaaacctaattaggttaagtttttccgggaagttaccgtacgtaaaccgtaccggttacccgttaaacggttccccgttagggaacggtaaccggaacggggtacgttaaacgttaccgtaacgtaccgggtttaaaacggggaacgggggttaaacgggggaaaccgacggggaaccgggttacggttaacccggtaacgttaccggtttacccgtttacggtaaccggtttcccggggg

SEQ ID NO: 332710 - DNA, 569 bp, Homo sapiens
  misc_feature: GZ8MTXP02H9PID.8.34.D01.1.454.CMB.2.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacgagagactctcgtgtgcagcctctggttcaccttcagtaactacggcatgcactgggtccnccaagctccaggcaaggggnttgggagtgggtgctaggttgttcagtcgtgagggtctaggttgttacagttgggtatcggcaggtactccgggtagaacggggccacttcacatctccagagacaatacagaacacaatgtattggagtctagaacagtactaagtccgtagacggacgacggtacgtatacgtacgtacggtacgaacgggacgggggaaccgaaggtacggggaacgttaccgaaggtaccgttaccgtttagtaccgg

SEQ ID NO: 332711 - DNA, 711 bp, Homo sapiens
  misc_feature: GZ8MTXP02J2YGT.8.34.D01.1.454.CMB.2.raw
  modified_base (333)..(333): a, c, t, g, unknown or other
  misc_feature (333)..(333): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtgagtctgggggagcgtggtccagcctgggagtcacagagactctcgtgtgcagcctcgtggtcaccttcacgtaactacggcatcgcacggtgggtccccaccgtaagccctaccgaggacccgtaaaaggggtntttaggggagttggggtcggacctaaggtttcgttacagttccgtggacggggtcaggttcgttacagtcgggtaatcggcagtaccttccggtaggaaacgggcccgtattccgaacctactacctaccgaagaacgtaacctaaacgttaccgaaaggaaaccacgtaattaggtagtttaggacggtactacggaaaacgtacgtaaccgttaaacggtccgttaggaaacggggtaccgaaccgggggtacttaaacgtaaccgttaaccgttagggtaaccgggaaacgggggtaacgggggaaaccccgaaggggtaccggggtaacgttacccgtaaacgttacccgttaccggtttcggttaaccccggg

SEQ ID NO: 332712 - DNA, 700 bp, Homo sapiens
  misc_feature: GZ8MTXP02IALEV.8.34.D01.1.454.CMB.2.raw
  modified_base (313)..(313): a, c, t, g, unknown or other
  misc_feature (313)..(313): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccagccgtgggaggtcacagagactctcgtgtgcagcctcgtcggtccaccttcacgtaactacggcatgcacgtgggcccncaagcctaccgaggacgaagggtattgggaggtgggtggcgtaggtttgtttcagttcgtggagggctaggttgttacagttgggtatcggacagtacgtccgtaggaacgggtccattccaccgtatccctacgaagacgaactaacttacccgaaaggaaacctaacgtaaagttaggtttaacgttagggaacgtacgtaacgaaaccgacgtaacccgttaaacggtcccgtaagggaacggtaaccggtaaccggggtacttaacgtaaacctacggtaacggtaaaaccggggaaagggggaaccgggggaaaccgaacgggggaccgggttaacgttaacccggaaacggtttacccgttaccggtttacggacccgggg

SEQ ID NO: 332713 - DNA, 565 bp, Homo sapiens
  misc_feature: GZ8MTXP02GL8H8.8.34.D01.1.454.CMB.2.raw
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacagagactctcgtgtgcagcctctgggttccaccttcagtaactacggcatgcacgtgggtcccnccaagcctccgaggcaaggggnttgggagtggggtgctaggttgtttcatcgtggagggctaggttgttcagtggtatgcagactcgtagacggcgatcaccatctcagagacaataccagaaacacaatgtattggagtactagaacagtacctaagtcctaggacggacgacgggacgtatactacgtacggtacggaacggggacgggggaacaagggacgggtacgttaccgtaacgtaccttccgtttacggtaccgg

SEQ ID NO: 332714 - DNA, 691 bp, Homo sapiens
  misc_feature: GZ8MTXP02GIG9R.8.34.D01.1.454.CMB.2.raw
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagacgactctgtgtgcacgcctcgtggttcaccttcacgtactacggcatcgcacgtcggccaccaagctccgaggcgaaggtntggngtgggngctagttntacatcgnggnggtctaggttcgttacaagttgggtatcggacgtacgtacccgttcggtagggaaaccgggtccgtacttacccgacctacgttccctaaccgaagaacgtaactaaaccgttaccgaaagaaacctaagtaagttagttacgtttagggactacgtaacgaaccgtaacgtaccgttaaggtcccgtagggaaccggacggtaccgggtacgttaaaaccgtacggtaacggttaacggggaaacgggaaacgggggaacggggaacccgtaggggtaaccgggtaaccggttaaccgtacgttacccgtttacggttacggtaccggtttcccggggg

SEQ ID NO: 332715 - DNA, 688 bp, Homo sapiens
  misc_feature: GZ8MTXP02GYOE2.8.34.D01.1.454.CMB.2.raw
  modified_base (271)..(271): a, c, t, g, unknown or other
  misc_feature (271)..(271): n is a, c, g, or t
  modified_base (460)..(460): a, c, t, g, unknown or other
  misc_feature (460)..(460): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtggttccaccttnagtaactcggcatgccacgtcggggtccccaccaagcctcccgaggaccaaaggggtatttgggaggttggggtgactaggtttgtttcagttctagggagggctaggttgttacaaagttgggtatcgacgtaggaccgttcgggtaggaaacggggtcccgtattaccaaccatcctacgacgaaanactaacgtaccgaaagaaactaactaaagttagttagttaggacgtacgtaacgaaaccgacgtaccgtaacgtacgtaggaccgggaaccggtacgggtaacgttaacgtaccgttacggtaacgggtaaacgggaaacgggggtaaccgggggaaaccgaaggtaccggggtaacgttaccgtaaacggttacccgttacgtttacggaccggttacggtacgggg

SEQ ID NO: 332716 - DNA, 625 bp, Homo sapiens
  misc_feature: GZ8MTXP02JXIQV.8.34.D01.1.454.CMB.2.raw
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagatgtggcgcctacgtatcctggtaccaacagaaacctggccaggcctcccacggccccctnactctatggtncatccaacgacggggccaacgtcggccactccccagcctagggttcaggtcggctaggtgggtagtggggaccaggtaccttcacttctaccaaccatcatccagccctagggacgccgtgagtagttggttgcgttagtttaacgttacgtagttactaactacgtaccgttaccggagtcggtcccggtcccgggggtcctaccggtttccgggacccggtacgggtaaccctaaagggtcggtactaacgtacgaaaacggtacgtacggttcggacgtggaccgtaacctcgttcttcgtaccttactcccg

SEQ ID NO: 332717 - DNA, 826 bp, Homo sapiens
  misc_feature: GZ8MTXP02IRVPK.8.34.D01.1.454.CMB.2.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagttgggctgaacttgggttttcctcgttgcttcttttaagaggtgtccagtgtcaagtgcaactggtggagtcgtgggggagcgtggtccagccgtggggagtcacagagactctcgtgtgcagcctcgtggttcaccttcagtaactacggcatgcacgtcgggtccnccaagctccgaggcaagggntgggagtgggtggctagtttgtttcagtcgtaggacggggtctaggttcgttacgagttgggttaattcggacgtaacgggtacccgtttcccggggtaagggtaaaccgggggtacccgttaagtttacccaacccttaacgttacccgttacccgaaacggtaaacggtaaaccgttaaaaccgtttaaacccgaaacgggtaaaaccctaaacgttaaaacgtttacggttttaagttttacggggaacggtaccgttaacggtaaaccgtaaccggttacccgtttaaaacggtcccgttaacggggtaaacgggaaccggtaaccgggggtacgttaaaccggttaaacccgtttaaacggttaaacggggttaaaccgggggtaaaacgggggtaaccggggggaaaaccccgtaagggggtacccgggggttaaacggtttaaaccccggtaaaacggtttaaccccgtttacccggtttacgggtttaaacccgggg

SEQ ID NO: 332718 - DNA, 589 bp, Homo sapiens
  misc_feature: GZ8MTXP02G95OV.8.34.D01.1.454.CMB.2.raw
  modified_base (310)..(310): a, c, t, g, unknown or other
  misc_feature (310)..(310): n is a, c, g, or t
  modified_base (417)..(417): a, c, t, g, unknown or other
  misc_feature (417)..(417): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagccaccctctcctgcagggccagtcagaatgttggcgcctacgtatcctggtaccaacacgaaacctggccaggcctcccaggcccctcatctatggtncatccaaacgcgggccagtggcactcccagccctaggttccaggtcggctaggtgggtatgggacagccttcactctcacatcatcacgcctggacgcctaggagtnttggttgacttagtttacttacgtgtaaccaactagttaccggtaccggtagttcggcccggttcccgggggtccctacggtttccgggcccgttaggggaaccctaaaggtcggataacgtacgaaacgacgtaggtcggactcgaccactacgtctcgttcctacgtacc

SEQ ID NO: 332719 - DNA, 577 bp, Homo sapiens
  misc_feature: GZ8MTXP02IPHLE.8.34.D01.1.454.CMB.2.raw
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagcccaccctgtcttcgtctccaggggaaagacgccaccctctcctgcagggccagtcagatgtgcnctagatctgacanagaacngcagcnccagccctnatnanggtncatccaagnggccagtggcactccagccagttnagtcgcaggtgggtangggacngtcttcactctcacctagtacatcacgccgtaggacgccgttaggacgtagttgttcgacttagtttacttactcgtacaactacgtaccggtacgtacggtccgggtcccggtacccgggggtccttacggttccggaccgtacgggaacctaaaggtcggtaaatacgtaaacgaaacggtacgtcggtacgcgtaacgaccactacgttcgtacgtttacctacgtaccc

SEQ ID NO: 332720 - DNA, 777 bp, Homo sapiens
  misc_feature: GZ8MTXP02GTIP5.8.34.D01.1.454.CMB.2.raw
  modified_base (376)..(376): a, c, t, g, unknown or other
  misc_feature (376)..(376): n is a, c, g, or t
tcagctcgcgtgtccacgaccggtgctcgatttagatcgtctgtgttgagctctgggagaggagcccagcactagaagtcggcggtgtttccattcggtgatcagcactgaacacagagactcaccatggagtttgggctgaacttgggttttcctcgttgcttcttttaagaggtgtccagtgtcaagtgacaacgtggtggagtcgtgggggagcgtggtccaggccgtggggaggtcacgagagactcgtcgtgtgcaggcctcgtggttcactttcaagtaacctaggcatgctacgtcgggtcccaccaagcctaccgaaggcgaaaggggtattgggaggtggggtgacgtaggtttgtttacagttcgngggtaacgggtctaaggtttcgttaactaaggttgggtaactcggaccgtaaacggtaccggttacccggggtaagggtaaaccggggtcccgtaaactttacccgaaacccgtaccttacccgtacccgaaggaaacggtaaaccctaaaccgtttacccgaaaagggaaaacccgtaaactaaagtttacgggtttaacgtttagggaacgtaacgtaacgtaaaccgaacggtaaccgtaacgtacccgtaagggaacggaaccggtaaccgggtacgttaaacgtaaccgttaacggtaacgggtaaaccggggaaagggggaaaccgggggaaaccgtcgggggaaacgggttaccgttaaccgaaacgtttaccgtacggtttacggtaaccggg

SEQ ID NO: 332721 - DNA, 842 bp, Homo sapiens
  misc_feature: GZ8MTXP02F7TWD.8.34.D01.1.454.CMB.2.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgccaccctctcctgcagggccagtcagatgtggcncctagtatctggtaccaacagaaacctggccagcctcccacggccccctnactctagtggtcgcactacccgaacgacggggccctacgtcggccaactccccgaaggccccgtagggttccaggttcgggaccgtaggggttaggggtaacgtcgggggaacctaagggtacccgtttccaaccttccgtacccaaccctatttaccaatccgtaacggtccctaggggaccgtacccgttaggggaacgggtagttcggtttacggaccgtttaaaggtttttaattttaaccgttacgggttaaacctaaaccgttaacgtttaacccgggttaaaccccggggttaacggggttcccgggtacccccgggtttacccgggggggccccctttaaacccgggtttttcccccgggggacccccggttaaacgggggtaaaacccctaaaaacgggggttcggggttaaaaccttaaacggttaaacccggaaaaaaccggttaaccgttaacggggttccggggtaacctttaacgggaacccttaaccgtaacgtttccggtttacggtttaccccttttacggtaacccccg

SEQ ID NO: 332722 - DNA, 661 bp, Homo sapiens
  misc_feature: GZ8MTXP02IITOD.8.34.D01.1.454.CMB.2.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (372)..(372): a, c, t, g, unknown or other
  misc_feature (372)..(372): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagtcctcgtggttcaccttnagtaactcggcatgcacgtgggtcccncaagctaccgaggcaagggnttgggagtggggtgctagtttgttcagtctggagggctagtgttacaagttggtntgcagcctccggtggaaacgggcctagttcacctagtctacccgagacgactaacgttaccaaaggaacaacaaagttagttaagtttgggacgtcttaaggaacctaacgtccgtaaacggtcccgtagggaacgtaccgtacggggtacttaacgttaacgtaacgtacgggttaaaccgggaaagggggtacgggggaaaaccgtacggggtacggggtaacggtttaacccgtaaaacggtttacgttacccgtttacggtaccggttacgggttaacccggggg

SEQ ID NO: 332723 - DNA, 679 bp, Homo sapiens
  misc_feature: GZ8MTXP02F25WK.8.34.D01.1.454.CMB.2.raw
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtggtccaggccgtggggaggtcacgagagactctcgtgtgcagcctcgtggtcaccttnagtaactcggcatgccacgtgggtcccncaagcctaccgaggacgaaggggtnttgggagtggggtgcgtagtttgtttcagttcgtggagggtctaggttgttacagttgggtatcggactacgtaccgtccggtagggaaacggggtcctaacttccgaacctatcctacccgagacgaacctaagttacccgaaggtaaaccactaaattaggttagtttagggaacgtacgtaacgaaacgtacgtaaccgttaaagtcccgtaagaaccggaacggtaaccgggtacgtaacttaacgtaaccgttagggaaaacgggaaacgggggacggggaaaaccgaagggaaccgggtaacgttaccgtaacgtttaccgtaccgtttacggtaacccggg

SEQ ID NO: 332724 - DNA, 705 bp, Homo sapiens
  misc_feature: GZ8MTXP02HSX0L.8.34.D01.1.454.CMB.2.raw
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccagggggaaagcgcccaccctctcctgcgagggccagtcaagatgttggccgctacgtntccgtaggtaccaacagaaaccgtggaccaggcctcccgacggccccctnacttctagtggtnccatcccgaaagcgggccacgtggctactcccagccgtaagggttcaggttccggacagggttcgggtagtcggggaactagtactttccaacttcctaccaacctactacactcgaacgtcccgtaggggaacgtcccgtaggggtaggtagtttcggttacgacgtttaagttttacttaacgttcgtaactaaacgttacgttccggtaacggtcggtccggcccgggttccgggggtacccttaccggttttcccggggcccgttaagggggaaccctaaagggtccggtaaataacgtaaaccggtaaaacgtcgtacgggtcggtccgttaacggacctaaccgttacggttaccgttcgtttcctacgtttaccccg

SEQ ID NO: 332725 - DNA, 579 bp, Homo sapiens
  misc_feature: GZ8MTXP02F45B5.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcacgtgggtcccgccaggcctcccgaggcgaaggggcttgggagtgggctgggctagtttgtttcatccgtagaaggtaagtgttacaaattactatacagactccgtgaacgggccattcacatctccagacgacaactaccaagaacacgatgtatctagacaagtagacagactaagagttgagacgacgtactagtttagtactaggtaacggtaaaggacgggggtaatacggaggtaagggacgaacgtaccgttacccgaaaaggttaccgttaacgttttacgg

SEQ ID NO: 332726 - DNA, 705 bp, Homo sapiens
  misc_feature: GZ8MTXP02GFXKE.8.34.D01.1.454.CMB.2.raw
  modified_base (309)..(309): a, c, t, g, unknown or other
  misc_feature (309)..(309): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagcccaccctctcctgcagggccagtcagatgtggcgcctacgtatcctaggtaccaacagaaacctcggccacggcctcccgacggcccctcactctanggtttgcctactaccaacgacgggcccacgtcggccactcccacgccgtaggttcaggtcggacgaggttaggggtagtcggggacctagggtaccttccgaaccttcctaccacctactcaactcacgaccgtgggaacgtcccgtggtacggagttggttcgacgttagttttacgtaccttgtaactaacgtactaccggttaaccgggtagtaccgggtccccggttacccgggggtcccgttaccggtttcccgggtaccccggtacgggggtaacccgtaaaacgggtacggtaaacgttaacgttaaccgaaaacggtaaccgtcggtaacggtaccgttaacggaccgtacccgtattacccgtacggttcccttacgtttaaccccg

SEQ ID NO: 332727 - DNA, 591 bp, Homo sapiens
  misc_feature: GZ8MTXP02GMLSF.8.34.D01.1.454.CMB.2.raw
  modified_base (329)..(329): a, c, t, g, unknown or other
  misc_feature (329)..(329): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (464)..(464): a, c, t, g, unknown or other
  misc_feature (464)..(464): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccaggccgtggggagtcacgagagactctcgtgtgcagcctcgtggttccaccttcaagtaactacgcatcgacacgtgggtcccacaagcctccgaggcgaagggtntgggaggtggggtggcgtaggtttgtttcagttcgaggagggctagtcgttanagtgtangcagtcncggtagacggctatcacatcctacgagaataaactacgagaacaaactatagttagttagagacgtanaacgacgtctaacgtcgtaggaacgacgacggtacgtactacgtacgtacggaacggaaacggggacggggaacgacggtaacgggtacgtaaccgtacggtacgttaccgttacggtacgtacggg

SEQ ID NO: 332728 - DNA, 702 bp, Homo sapiens
  misc_feature: GZ8MTXP02F65LT.8.34.D01.1.454.CMB.2.raw
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctcgtgtgcagcctcgtggttcaccttcagtaactacggcatgcacgtgggtccnccaagcctccgaggcgaaaggggtnttgggaggtggggtggctaggtttgtttcatcgtggagggcaggttgttacaagttgggtatgcaagtaccgtccggtaggaaacgggggtccctaagtttccaacccgtactccgtacccgaaaggaacgaactaaacttacccgaaagggaaaacctactaaaagtttgttaaagtttagggaacgtacgttaacggaaacctacgacccgttaaagtcccgtaagggacggaaaccgtacgggtacgtaaacttacgttaacgtaacggttaaacgggaaacgggggtacgggggaaaaccggacgggtaccggggtaacgttaaccggtaaccggttacgttacccgtttacggttaccggtacggtaccggggg

SEQ ID NO: 332729 - DNA, 591 bp, Homo sapiens
  misc_feature: GZ8MTXP02JD49H.8.34.D01.1.454.CMB.2.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (315)..(315): a, c, t, g, unknown or other
  misc_feature (315)..(315): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacagganactctcgtgtgcagcctctggttcaccttcagtaactacggcatgcactgggtccncaagctcaggcagggnttgggagtgggtgctagttgttcagtcgtggaggcagtgttacagtggtatgcagtcgtcgagaggccgtatcgacatctacagacactaatccaaggaaacacgtaataggttaagtttggagtacgtagaacgacgtaccgtaaacgtcctagggaacgaccgtacgggtacgttactaacgtacgtacggaacgggtaaacggggaacgggggtaaccgaagggtacggggtacgttaaccggtagttaaccgtccgtttacggtaacccggg

SEQ ID NO: 332730 - DNA, 750 bp, Homo sapiens
  misc_feature: GZ8MTXP02H1N8W.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggaggtcacgagagactctcgtgtgcagcccttcgtgggttccaccttcagtaactacggcatcgctacgtcgggtcccaccaagccgtaccgaaggacgaaggggtgtttgggaggtggggtacggtctaggtttcgtttacagttccgtagggacggggtctaggttcgtttacgaaggttgggttactgaccgtacggtaccgttaccgggtagggaaaccggggtcctacttacccgaaacctactaccgtaccgaaacggtaaacgtaaccgtaacttacccggaaacggtaaacctaaacgttaaaggttagtttaggtttaacgggacgttaccgtaacgaacgtacgtaccgttaaacggttccgacggtaacgggtaccggtacggtacgttaacgtaacgttacggaacgggtaaacgggaaacgggggaaccgggggaccgtaacgggaccgggtaacgttaccgtaacggtacccgttacggttacggtaccggttacggtcccggggg

SEQ ID NO: 332731 - DNA, 751 bp, Homo sapiens
  misc_feature: GZ8MTXP02F3VEO.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagttgggctgaacttgggttttcctcgttgcttcttttaagaggtgtccagtgtcaagtgcaacgtggtggagtcgtgggggagcgtggtccagccgtgggaggtcacagagactctcgtgtgcagtcctcgtggttccaccttcaagtaactcggcatcgccacgtcggtacccgccaagcctaccgaggaccgaagggtattgggaggtgggtgctaggtttcgttaccagttcgtagggacggggtctaggttcgttacgaaagttgggtaatcggaccgtaacgggtacccgttacccgggtagggaacccggggtacccgtaacttcccgaaaccctacgttaccccgtacgaaacggtaccgtaaacctaaaccgttaacccgaaaacgggtaaacctaaacgtaaagttagtttaagtttacgggaactacgtaacgaaccgtaacgaacccgttaagtacccgtagggaaaccggacgggtaaccggtacgttaaacgtaaccgttaaacggtacgggtaaaacgggaacgggggaaaacgggggaaccgaacggggtaacggtaacggtaaccgtaacgtttacccgttacgtttaaccggg

SEQ ID NO: 332732 - DNA, 706 bp, Homo sapiens
  misc_feature: GZ8MTXP02GD9IZ.8.34.D01.1.454.CMB.2.raw
  modified_base (300)..(300): a, c, t, g, unknown or other
  misc_feature (300)..(300): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagccgtgggaggtcacagagactctcgtgtgcagcctcgtggttcaccttcagtaactcggcatgcacgtgggtcccncaagctccgaggcaagggattgggaggtggggtggctaggtttgtttcagttcgtggaggggtctaggttgttacaagttgggtatgacagtacctccggtaggaacgggcccgtacttccaaccctacttccgtaccgaagaacgaacctaaacttacccgaaaggaaacctaaccgtaaagttaggttaaagtttgggaacgtaccgtaggaaaccgaacgtacccgttaaacggtacccgtaggaacgggaaccggtacggggtaacttaacgttaaccgttaacgtacgggtaaacggggaaacgggggaacgggggaaaccgacggggtacggggtaacggtttaccggtaaacggttacccgttaccggtttacgggtaaccggttcggtaacccggggg

SEQ ID NO: 332733 - DNA, 707 bp, Homo sapiens
  misc_feature: GZ8MTXP02GHEHZ.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctcgtggttcaccttcagtaacacggcatgcacgtcgggtcccgccaagcctaccgaggaccgaaggggtattggggagttggggtgcgtaggtttgttcccagttcaggagggctaggttgttcaaagttggtatgcaagccgttccggtaggaacgggtaccgtattaccaacctacttacctaccgaagaacgaactaaacgttccgaaaaggaacctaaacgtaaagttagttaacgtttagggaacgtacgttaaggaaaccgtacggtaacccttaaacggtccgtacgggaacggaccggtacgggtacgttaacttaaccgtacggtaacgggtaaaaccggaacggggggtaaaaccgggggaaaccgtacgggggaaccggggttaaccggttaacccgtaaacgggtttaccgtttacccggtttacgggg

SEQ ID NO: 332734 - DNA, 697 bp, Homo sapiens
  misc_feature: GZ8MTXP02GQWPO.8.34.D01.1.454.CMB.2.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctgtgggttcaccttcagtaactcggcatgcacgtgggtccnccaagcctccgaggcgaagggtnttgggaggttggggtggctaggtttgttcatcccgtggaggctagttgttcaagttgggtatggacagtcctcgggtaggaacgggtccgtattacccaccacttcctacccgaagaacgaacctaaacgttaccgaaacgggtaaaccaaacgtaaagttacgtttaagtttacgggaacgttaccgtagaaacccgtaacggtacccgttaaacggtaccgtaggaacgggaaccggtaccggggtacttaacgttaaccgtaacggttaacggtaaacgggtaaacgggggaaccgggggaaaccgtacggggaaccggggtacgttaacccgaaacggttaccgtttaccggtttacggtaacccggttccgggg

SEQ ID NO: 332735 - DNA, 725 bp, Homo sapiens
  misc_feature: GZ8MTXP02GBXMJ.8.34.D01.1.454.CMB.2.raw
  modified_base (342)..(342): a, c, t, g, unknown or other
  misc_feature (342)..(342): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagttgggctgaactgggttttcctcgttgctcttttaagaggtgtccagtgtcaagtgcaactggtggagtcgtgggggagcgtggtccagccgtgggaggtcacagagactcgtcgtgtgcacgccttcgtcggttcaccttcaagtaactacggcatcgcacgtcgggtccaccaagcctacccgaggaccgaaagggtnttggggaggttgggtggctaggtttgttacccattcgtggacgggtctaggttcgttacgaagtggtatcgacgtaaggtacccgtaccgggtaggaacggggtacccgtaacgtaccaaccgtacttacccgacccgaaggaacgtaacctaaaacgttacccgaaaacggtaaacctaaaccgtaaacgtttaggttaagtttaacgggaacgtaccgttaacgaaacgaccgtaaccgttaaacgtacccgtagggaacggtaacgaccggggtaactaaccttaacgtaacgtacggtaaacggggaaacggggaacgggggaaaccgtaagggaccgggtaaacgtaccgtaaacggttacccgttacgtttaccggg

SEQ ID NO: 332736 - DNA, 642 bp, Homo sapiens
  misc_feature: GZ8MTXP02JEE19.8.34.D01.1.454.CMB.2.raw
  modified_base (301)..(301): a, c, t, g, unknown or other
  misc_feature (301)..(301): n is a, c, g, or t
  modified_base (386)..(386): a, c, t, g, unknown or other
  misc_feature (386)..(386): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggaggtcacagagactctcgtgtgcagcctcgtgggttcaccttcagtaactacggcatgcacgtcgggtcccncaagcctaccgaggcaaggggtcttgggagtggggtggcttaggttgttacagtctggacggctaggttgttacaagttcgggtntcgactacggtacttcccgggtaggaaacgggtccctaagttccactacgtctacccgagtacactaacttaccgaaggaacaacgtaaatgttaagtttcggacgtacgttagaaactaccgtacgtaacgtccgtaggacggtaacgacggtacgtaataccgtaagtcggtaaacggaaggggtacggggaaaccagggtacggaacgtttaacgaacggttaccttacgttacggaccgttacgtaccgggg

SEQ ID NO: 332737 - DNA, 747 bp, Homo sapiens
  misc_feature: GZ8MTXP02G1CX9.8.34.D01.1.454.CMB.2.raw
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
tcagctcgcgtgtccacgaccggtgctcgatttagatcgtctgtgttgggtttggggtctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccaggccgtggggaggtcacagagactctcgtgtgcagcctcgtggttcaccttcagtaactacggcatgcacgtcgggtccnccaagcctaccgaggcaaaggggntttgggaggtggggtggctaggtttcgtttcagttcgtggacggggctaggtcgctcgaaagttggtatgcacggacgttccggtaggaacgggccgtattaccacctactacctaccgaagaacgaaacctaaacttacccgaaacgggaaacctaaacgtaaagtttaggtttaaagttttaggggaacgtaccgttaagaaaaccgtacggtaaccccgtttaaacggtacccgttaaggggaaccgggaaccggtaaaccgggggttaccttaaacgttaaaccgttaaacggttaccgggtaaaaccggggaaacgggggaaacggggggaaaccgaacgggggtaccgggggttaaacggtttaacccggtaaacggtttaacccggtttaccggttttaaccggg

SEQ ID NO: 332738 - DNA, 710 bp, Homo sapiens
  misc_feature: GZ8MTXP02GKE2Y.8.34.D01.1.454.CMB.2.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctgtggttcaccttcagtaactacggcatgcacgtgggtccncaagctccgagcaaggnttgggagtgggtgctagtttgttcatcgtggagggctaggttgttacaagttgggtatgacgtaggtaccgtcccggtagggaaaccgggggtcccgtaactttccgacccgtagttacccgttacccgaaggtaacgtaaccgtaaacgtttacccgaaacgggtaaaccaaacgttaaacgtttagttaaacggttttagggaacgttacgtacggtaaaccgtaacggtacccgttaaacggtccgtacgggaacggaaccggtacggggtacgttaacgttaccgttaacgtacgggtaaacgggaacggggaacgggggtaaaccgagggtaccgggtaacgttaccgtaacggttaccgttaccgtttacggtacggttacggtaccggggg

SEQ ID NO: 332739 - DNA, 726 bp, Homo sapiens
  misc_feature: GZ8MTXP02HJO40.8.34.D01.1.454.CMB.2.raw
  modified_base (262)..(262): a, c, t, g, unknown or other
  misc_feature (262)..(262): n is a, c, g, or t
  modified_base (343)..(343): a, c, t, g, unknown or other
  misc_feature (343)..(343): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtgggagtcacagacgactctcgtgngcagcctcgtggtccaccttcaagtaactacggacagtcgcacgtcgggtccgaccaacgcctacgaggacgaaaggggtnttaggggaggttggggtacggtcgttaaggttttcgttaccgacgttcgtgggaggggtctaaggtttcgttaccgtaaagttggggtaacgttcgacgtaacggtaaaccgttcccgggtaacgggtaaacggggtacccgtaacgtttacccgaacccgttaaccgttacccgttacccgaaaggtaaacgtaaacctaaaccgttaacccgaaaacgggtaaaccaacgtaagttagttacgttagggacgtacgtacgaaacgtacgtaaccgtaacgtaccgtacgaacggaccgaacggtcttaaacgtacgtacgtacggtaaacggaagggaacggggaacgagggacggtacgtacgtacgttacttccgtagg

SEQ ID NO: 332740 - DNA, 695 bp, Homo sapiens
  misc_feature: GZ8MTXP02FLORY.8.34.D01.1.454.CMB.2.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagtccctcgtgggttcaccttcagtaactacggcatgcacgtgggtcccnccaagctccgaggcaagggtattgggagtgggtgcgtagttgttnatcgtggagggtcagttcgttcaagttggtatgacagtacctccgggtaggaacgggcccgtagttaccaaccgtactccgtaccgaaggtaacgacctaaacttacccgaaagggaaacctaacgtaaaagttgttaaacgtttacgggacgtacgtacggaaactaaccgtaccgttaaacggtcccgtaagggacggaaccgtacggggtaacgttaacgttacgtaaccgtacgggttaaacgggaaacgggggtaacgggggaaacccgaggggtaccggggtaacggttacccgtaaacggttacccgttaccgtttacggaaccggttccggtaacggggg

SEQ ID NO: 332741 - DNA, 571 bp, Homo sapiens
  misc_feature: GZ8MTXP02F3U5A.8.34.D01.1.454.CMB.2.raw
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacgagagactctcgtgtgcagcctcgtgggttccaccttcagtaactacggcatgcacgtgggtcccnccaagcctccaggcaaggggnttgggagtggggtgctagtttgttcagtcgtggagggctagttgttcagtggtatgcagactcgtagaggcatcacatctacagagactaactacgagaaacacaaatgttattggatactagaacacgtacctaagtccgtagacggacgacggggtacttaactacgtacgtaggtaacggaaacgggggacgggggtaacgaagggacgggtacgtaccgaagtacgtacgttacgtaccggg

SEQ ID NO: 332742 - DNA, 815 bp, Homo sapiens
  misc_feature: GZ8MTXP02JWV5C.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctggaacctgggttttcctcgttgctcttttaagaggtgtccagtgtcaagtgcaacgtggtggaggtcgtgggggagcgtagtccagcctggggagtcacagagactctcctgtgcagccctcgtggtcaccttcagtagctacggctagtgcacgtcgggtcccgaccaaacgtcccgaggcgaaagggtagttggggagtggggtcggctaggtttcgttccagttcgtagggacggggctaggttgttcgaaagttcgggtactggaccgttacgggaacccggttcccgggtaagggtaaccgggggtacccttacgttacccgaacccgtaactttacccgtacccggaaaggaaccggaaaccttaaacccgtacccgaaacgggaaaaccctaaacgtaaacgttaagtttaacggtttaacccgggaacccttaaggaaacccgtaaccggtaaccccgttaaaggtccccgttaaggggaaccggtaaccggtaacgggggttacttaacgttaaaccggttaaaccggttaggggttaaaaccgggtaaaacgggggtaacccggggggaaaacccgaacgggggtaacccggggtaacgtttaacccccgtaaaaggtttacccccgtttaaccggtttacggttaaacccgggg

SEQ ID NO: 332743 - DNA, 597 bp, Homo sapiens
  misc_feature: GZ8MTXP02IC7XG.8.34.D01.1.454.CMB.2.raw
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (406)..(406): a, c, t, g, unknown or other
  misc_feature (406)..(406): n is a, c, g, or t
tcagctcgcgtgtccacgaccggtgctcgatttagatcgtctgtgttgagctctgggagaggagccccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctggggaggtcacagagactctcgtgtgcagcctcgtggttccaccttcagtaactacggcatgcacgtgggtccnccaagctccgaggcaagggntgggagtgggtgctagttgttcagtcgnggaggctagtgttacagtgggtatgcagtactccggtagaacgggcattcacatcnccgagagactaatccgagaacactaatgttagttggagcgtagaacacgtacctaaacgtccgtaggaacggacgacgggtacgttacgtaacgtaacgtacggtaacggggaaacggggacgggggaaaccgaaggggtaccggggtaacggttaccgtaaaggttacccgttacgtttacggtaccggg

SEQ ID NO: 332744 - DNA, 674 bp, Homo sapiens
  misc_feature: GZ8MTXP02JVEFG.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtggggagtcacgagagactctcgtgtgcagcctcgtggttcaccttcagtaactacggcatgcacgtggcagcccaagcctaccgaggcgaaggggtattgggagtggggtgctaggtttcgtttcgattacgtaaagggctaggttgtcaaagttggtatgacaagtaccgttaccggtaggaacgggtccgtacttaccaccctactacctacccgaagaacgtaaactaacgttaccgaaacggaaacaacgtaagttagttagtttagggacgtacgtacgaacacggtacctaacggtccgtaggaacggacgaccgggtacgttaacgtaaccttacggtacggtaaaccgggaaacgggggtaaccgggggaaaccgaacggggtaccggggtaacgtacccgtaaacggttacccgttacgtttaccggg

SEQ ID NO: 332745 - DNA, 661 bp, Homo sapiens
  misc_feature: GZ8MTXP02H86C9.8.34.D01.1.454.CMB.2.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggaggtcacagagactctcgtgtgcagcctctggttcaccttcagtaactacggcatgcacgtgggtcccncaagcctccaggcaagggnttgggagtggggtggctagtttgttcatctggagggctagtgttcaagttgggtatgacaggtcctccgggtagaacgggcccgattcgacctatctaccagacgaactaacttaccgaaaggaacaactaaattaggttaacgtttagggaacgtaccgttagaaacctacgtacccgttaagtacccgtaggacgggaaccgtaacggggtaccgttaacgtaaccgttaacgtacggtaaacgggaaacgggggacgggggaaaccgtacgggaaccggggtaacgttacccgaaaacggtttaccgttaccgtttacggtaccggttacggtaccggggg

SEQ ID NO: 332746 - DNA, 751 bp, Homo sapiens
  misc_feature: GZ8MTXP02H5X11.8.34.D01.1.454.CMB.2.raw
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtggtccagcctgggaggtcacagagactctcgtgtgcagcccttgtgggttccaccttcagttaacncggcatgcacgtgggtccccncaaaggcctaccgaggacaaaaggggtnttggggaagtgggggtacgctaaggtttcgtttacagttccgtggggtaacggggtagttcggtactaaagttggggttatcggactaacggtaccgttcccggtaaggaaacgggggccctaacttaccaacccacgttacctcccgaaaggtacgaaactaaacttacccgaaaggaaaaccctaaacgtaaacgttaggttaacgtttacggaacgtacgtaacgaaaccgaacgtaaccgttaacgtaccgtacggaacggaaccgaaccgggtacgtaaacgtacgtaacggtaacggaaacgggaaacgggggaaaccgggggaaaccgtaacggggtaaccgggttaacggttaaccgtaaaccggttaaccgtttaccggttacggtaaccggttaccggtacggggtacccgg

SEQ ID NO: 332747 - DNA, 642 bp, Homo sapiens
  misc_feature: GZ8MTXP02GRX6R.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagcctgggaggtcacagagactcgtcgtgtgcagccctcgtggttccaccttcagtaactacggcatgacacgtgggtccgccaagctacccgaggtccaaaggggatttgggaggtgggtggctaggtttgtttccatcgtggagggcaggttgttcaagttggtatcgcgagtacgtccggtaggaacgggccgtacgtaccaccctagtcccgtccgaagaacgaactaacgtaccgaaaggtaaaccaactagttagttagttagggacgactagaacacgtaccgtaagtccgtacggtaggaaccgacgggtacgtaacgtaacgtacgtacgggtaacggaacgggggaacgggggaaccgaggggacggtacggttaccgaacgttaccgttacgtttacgg

SEQ ID NO: 332748 - DNA, 557 bp, Homo sapiens
  misc_feature: GZ8MTXP02IXT9Z.8.34.D01.1.454.CMB.2.raw
  modified_base (297)..(297): a, c, t, g, unknown or other
  misc_feature (297)..(297): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagttgggctgaactgggtttcctcgttgctcttttaagaggtgtccagtgtcaagtgcaactggtggagtcgtgggggagcgtggtccagcctgggaggtcacagagactctcgtgtgcagcctcgtgggttcaccttcagtaactacggcatgcacgtgggtccnccaagctccgaggcaagggattgggagtggggtggctagttgttcatcgtgaggcagtgttcagtggtatgcagactcggtagacgggcgattcacactctcagagacaacttaccaggaaacacaatagttatttaggagctacgaacacgtaccgtaaagtccgtagacggacgacgggacgtatacgtacgtacgtacggaagggaacgggggaacgaacggacgggacgttacgaacgtactccgtttacgtacgg

SEQ ID NO: 332749 - DNA, 742 bp, Homo sapiens
  misc_feature: GZ8MTXP02HH9OV.8.34.D01.1.454.CMB.2.raw
  modified_base (335)..(335): a, c, t, g, unknown or other
  misc_feature (335)..(335): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagccgtggggaggtcacagagctctcgtgtgcagcctcgtgggttcaccttcagtaactcggcatgcacgtcgggtcccgaccaagcctcgaggcgaaggggtnttgggagtcggggtggtactaggtttgttccagtcgtaggagggtctaggttgttacgaaagtttgggtaacgttgccgtaaggtacccgttaccggggtacggggaaacgggtacccggtaacgttacccaaccctacgttaccccgttacccaaaaggtaccggtaaaacctaaaccgttaacccgaaaacgggtaaaacctaaaccgtacgtttaaggttaggtttagggaacgtaccgttaacgaaaccgtacgtaacccgttaacgtacccggtagggaaccgggaaccggtacggggtacttaacgtaacgtaccggtaggtaaacggggaacgggggaacgggggaacgacgggtacggggtaacgttaccgtaacggttaccgttaccggtttaccggg

SEQ ID NO: 332750 - DNA, 626 bp, Homo sapiens
  misc_feature: GZ8MTXP02IKIRT.8.34.D01.1.454.CMB.2.raw
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtccttcgtctccgaggggaaagagccaccctctcctgcagggccagtcagaatggttggcgctacgtatcctggtaccaacagaaacctggccaggcctcccacggccccctnactctatgggtcncactcccaaagacggggcccaacgtcggacactcccgagccgaggttcaggtcggactagggtggggtatggggacagtccttcgactctaccaccntacatcagcctggacncctgagntggttgactagtttacttactgtacaaactgtaccgtaccgtaggtccggtcccggtccgggggaccctacggtttccggacccgttggggaaacccgtaaggtcggaactacggttaaccgaaaacggttaacgtcggttaacggcctcggaccctaaccgttactccgtttacgtccctttactacccg

SEQ ID NO: 332751 - DNA, 764 bp, Homo sapiens
  misc_feature: GZ8MTXP02JMWW5.8.34.D01.1.454.CMB.2.raw
tcagctcgcgtgtccacgaccggtgctcgatttagatcgtctgtgttgggtttgggctgaactgggttttcctcgttgctcttttaagaggtgtccagtgtcaagtgcaactggtggagtcgtgggggaggcgtggtccagcctgggaggtcacagagactctcgtgtgcagcctcgtgggttcaccttcagtaactacggcatgcacgtcgggtcccaccaagcctccgaggcgaaaggggtattgggaggtggggtggctagtttgtttcagtcgtggagggctaggttgttacaagttggtatggacacggaccgttccggtaggaaacggggtcctaacttaccgaaccctaatccgtaccgaaggaacgaacctaaacttaccgaaaggaaacctaaactaagttagttaagtttacggacgtactaacgaaacgacgtaaccgtaaacgtccgtaaggaaacggaccgtaacggggtacttaacgtaaccgtacgtaaggggaaaccgggaaagggggaacggggaaaccgagggtaacggggtactaccgaaagttacccgttcgtaggacgttacgggtacggggacctaacggggtaccctgggtaccctaccgttcctaccgacgacccggtccctaaccggaaccggtaaccgggccccttacggttccccggtccccttccccgggacgtcccgtcccgtcgcccaccggaaggtacccacccggtaccccgtaggacaaccgacggaaccg

SEQ ID NO: 332752 - DNA, 632 bp, Homo sapiens
  misc_feature: GZ8MTXP02IF81R.8.34.D01.1.454.CMB.2.raw
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggagtcacgagagactctgtgtgcagcctntggttcacttnagtaactacggcatgcacgtggccncaagcctcgaggcgaagggtattcgggagtgggtgctagttgtcatccgtggaggctagtgttacaagtgggtactgaccgacgacgtccgaggaaacggcgtatcaccatcgtaccagtacgtaactaactacccgaagaaccaataagttagttaagtttgggactacgtagaaacgtacggttacctaacggttaccgagtaacggacgtacccggggtacttataacccgtaagttaacggaaaccggtaaggggaaccgggggtaaccaacggggtaacgggtaacgttaccgtaaacgggttaaccttccggtttaaggacggttcccgggg

SEQ ID NO: 332753 - DNA, 692 bp, Homo sapiens
  misc_feature: GZ8MTXP02HL6WG.8.34.D01.1.454.CMB.2.raw
  modified_base (337)..(337): a, c, t, g, unknown or other
  misc_feature (337)..(337): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagccgtgggaggtcacagagactctcgtgtgcagccctcgtggttccaccgttcaagtaacctacggcatcgcacgtgggtccccacctaagcctacccgaggacgaaaggggtnttggggacggtggggtaggcttaggtttgtttacagtcgtaggagggtctaggttgttacgagtggtaatcgacgtaagtaccgtccggtaggaacgggtcccgtattccaacctatccctacgaagtaacgaactaacttaccgaagtaaaccaaataaagttagttagttaggagtacgtagaaactacgtaccttaaacggtccgtaggaaacggaaccgtacgggtacgttaagtaaccgtacgttaaacgggaacgggaaaacgggggaacgggggaaacccgtaaggggtaccgggtaaacggttacccgtaaaacggttacccgtttaccggtttaacggtacccggg

SEQ ID NO: 332754 - DNA, 556 bp, Homo sapiens
  misc_feature: GZ8MTXP02FFHL4.8.34.D01.1.454.CMB.2.raw
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
  modified_base (352)..(352): a, c, t, g, unknown or other
  misc_feature (352)..(352): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcggtgngcagcctntgggttccaccttcaagtaacacggcatgcacgtgggtcccnccaagcctccgaggcaaggggntgggagtggggtgcagtttgttcagtcnggagggcagtgttacagtggtatgcagactccggagaaacgggccgattccaccatcctccagagacaatccagaacacaatgtattggagctagaacagactaacgctagaggacgacgggacgtataacgtacgtaggtaacggaacgggacgggggaaccaagggacgggacgttaccgaagttacctcgtttaggaccgg

SEQ ID NO: 332755 - DNA, 688 bp, Homo sapiens
  misc_feature: GZ8MTXP02HBT9L.8.34.D01.1.454.CMB.2.raw
  modified_base (271)..(271): a, c, t, g, unknown or other
  misc_feature (271)..(271): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagttgggctgaacttgggtttcctcgttgcttcttttaagaggtgtccagtgtcaagtgcaactggtggagtcgtgggggagcgtggtccagccgtgggagtcacagagactctcggtgtgcagcctcgtggtccacctnacgtaactacggcagtgcacgtcgggcccacaacgcctaccgaggacgaaggggtattgggaggtggggtcgacgtagttcgttcacgtcgtggaggctagtgttacagtgtatgcagtaccgtcgtagaacgggctacgtacaccatcctacgaagaacgtaacaacgttacaaacggaaactaacgtaattgtttaagttaggacggtactaacggaaacgacgtaacccgttaacggtaccgtagggaaacggaccggtaaacgggggtaccttaaacgttaaaccctaagggttaacggggtaaaacggggaaaacggggggaacgggggtaaaaccggaacggggtaaccgggttaaccgttaaaccggtaaaacggtttccgtttaacccggggtttaacgtaacccgggg

SEQ ID NO: 332756 - DNA, 624 bp, Homo sapiens
  misc_feature: GZ8MTXP02G8HM1.8.34.D01.1.454.CMB.2.raw
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctgggagtcacagagactctcgtgtcgcagtcctcgtggttcaccttcagtaactacggcatgcacgtgggtcccncaagcctccgaggcgaagggnttgggagttggggtggctggtttntttcatcgnggacgggctagttgttacagttcggaatggactagacgtccggtaggaacgggcctacttcgacctattccacagtactaacgtaattaccgaagaaacctaactaagttaggttagttacgggagtacgttacgaacgtacgacgttaaacgtccgtaggaacggacgtacgggtacttaatacgtacgtacggtaaccggaaggggtaacgggggaacaaggggtacggtaacgttacgtaacgtaccgttacgttacggtaccggg

SEQ ID NO: 332757 - DNA, 584 bp, Homo sapiens
  misc_feature: GZ8MTXP02ITI6M.8.34.D01.1.454.CMB.2.raw
tcagctcgcgtgtccacgaccggtgctcgatttagatcgtctgtgttgggtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtgcagttgtttcatctgaggcagtgtcaatggtatgcagactcgtgaaggccatcacatctcagagacaattccagaacacaatgtatttggagctagaacagacctaagtccgtagaacggacacgggcgtaatacctatgtaacgaaggagggggaacaggacgggagttaccgaagtactccttagacgtcgtacgggccgtacgggtaccctggtccgacccgtcctccgtcacgccctccgaccgacggccccacgtcccggttccttcccccgtggcccgcccgtcgccctaccgaacggaccgacccgtacccgtaccgacgacgaccaaccgg

SEQ ID NO: 332758 - DNA, 681 bp, Homo sapiens
  misc_feature: GZ8MTXP02FWVKD.8.34.D01.1.454.CMB.2.raw
  modified_base (272)..(272): a, c, t, g, unknown or other
  misc_feature (272)..(272): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttggctgaactgggtttcctcgttgctcttttaagaggtgtccagtgtcaagtgcaacgtggtggagtcgtgggggaggcgtggtccaggccgtgggagtcacagagactctcgtgtgcagcctcgtggtccaccttnagtaacacggcagtgcacgtcgggtccacaagcctccgaggcgaaaggggtatttggggaggttggggtacggtacgtaggtttcgtttacacgttccgtagggacgggtctaggttcgttactagtcggtatcgacagtacgtccggtaggaacgggacctacgttaccacctattcccgaccgagaacgtactaacgtaccgaaacggaactaaacgtagttaggttacgtttacggaacgtacgtaaacgaaccgtacggtacccgttaaaacggtcccgtaaggacggtaaccggtacggggtacttaacgtaccgtacggttaaggaacggggaaacggggacgggggaacaacggggtacgggtaacgttaccggaaacgtcgttaccgttacggtaacccgg

SEQ ID NO: 332759 - DNA, 638 bp, Homo sapiens
  misc_feature: GZ8MTXP02GBXSP.8.34.D01.1.454.CMB.2.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtggggaggtcacagagactctcgtgtgcagcctntgggtcaccttcagtaactacggcatgcactgggtcccncaagctccaggcaagggattgggagtggggtgctagttgttcatcgtgaggcagtgttacagtggtactgctagacgtcgtagaaacggccgtattcacctatcctaccgagaacgactaaacgttcccgaaaggaaacaacgtaaattagttaagtttagggaacgtacgtacgaaacgtacgtaccttaaacggtccgtaggaacgggtaccgaacgggggtacttaacgtaaccgtaacgttacgggtaaccgggaaaagggggaccgggggtaaaaccgaacgggacggggtaacggttaccgaacgttacgttacccggtttagtaacccggg

SEQ ID NO: 332760 - DNA, 657 bp, Homo sapiens
  misc_feature: GZ8MTXP02GI985.8.34.D01.1.454.CMB.2.raw
  modified_base (305)..(305): a, c, t, g, unknown or other
  misc_feature (305)..(305): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggaggtcacagagactctcgtgtgcagtcctcgtgggttccaccttcagtaactacggcatgccacgtcgggtcccnccaagcctccgaggacgaaggggtattgggaggtggggtggctaggtttgtttcagttcgtggacggggctaggtgtttacgaagttgggtatggacagtaccgtccggtaggaacggggcctagttccaccctataccgtaccgaagacgaacctaacgtaccgaaggaacaactaagttagttacgttaggaacgtacgtagaacgacgtaccgttaacgtcgtaaggacgaacgacgggtactaacgtacgtaacgtacggtaacgggaaacggggaacgggggtaaccgacgggacggtaacgtaccgtaagttaccgttaccgttacggtaccggtcggtaccgggg

SEQ ID NO: 332761 - DNA, 604 bp, Homo sapiens
  misc_feature: GZ8MTXP02JV3IB.8.34.D01.1.454.CMB.2.raw
  modified_base (211)..(212): a, c, t, g, unknown or other
  misc_feature (211)..(212): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (392)..(392): a, c, t, g, unknown or other
  misc_feature (392)..(392): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagatacccaccggagagattgtgttgacacaatctccagcccaccctgtcttcgtctccagggggaaannccaccctcctcctgcagggccagtcagaatgtgcgcctagtatccngtacaacnaaacctggccaggctccccaggccccctcatctatggtcgcaatccaccaggggcccaactggcattcccagcctggttacaggtcggcaggtcgggtaatggggacagctttcactcctcaaccnctacatcacgcgtcggcgcgtagagtagttgttgtctagtttaactttacttacgttacaactacgtacggtaccggtacggtcgtccgggtcccggggtcccgtaccgttaccggtacccggtaccgtaaacggtaaacggtagtaagtaactaacgaaacgtaaacgtacggtcggtcgtcgtacgacctacttcttcgtttcttactac

SEQ ID NO: 332762 - DNA, 833 bp, Homo sapiens
  misc_feature: GZ8MTXP02JE8QY.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcggtgggggaggcggtggtccaggccgtggggagtcacgagagactctcgtgtgcagcctcgtggtccaccttcgaagtaacctacggacagtcgccgacgtcggggtcccaccgaacggtcctaccggaggacgaaggggtgtttacggggagggttcggggtggtaccgttaaggttttcggtttctacggtttcgtaggggtaacggggtacgttagggtttacgttacgtaagggtttggtaacgttacgggaccgtaacgggtacccggtttaccgggtaaagggggtaaacccgggggtacccttaacgtttaaccccgaacccgttaattacccccgtaaccggaaacggtaaaccgtaaaccgtttaaaccgttaaaccccggaaaagggtaaaacccccttaaacgtaaagtttacgggtttaagtttaacgggaacgttaccgtaaacggaaaccgtaccgtaaccgttaacgtcccggtagggaaacggaacgtaccggggtactaacgttaccgtaaacggaacggtaacggggaaaacgggggaccggggaaaacgcgggtacggggtaaccgttacccgtaacgtttaccgttaccggttacggtacccgggg

SEQ ID NO: 332763 - DNA, 669 bp, Homo sapiens
  misc_feature: GZ8MTXP02FGGVG.8.34.D01.1.454.CMB.2.raw
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggagtcacagagactcncgtgtgcagcctctgggttcaccttcagtaactacggcatgcacgtgggtccnccaagctccaggcaagggattgggagtggggtggctagtttgttcagtctggaggggcagtgttacaagtgggtatggcagaccgtccgtaggaaacgggcctaacgttccaaccctactcctaccgaagtacgaactaaacttacccgaagggaaaccaactaaagttgttaagtttgggacgtacgtagaaccgtacgtaccgtaaacggttcccgtaggaacggtaccgacggggtacgtaacgtaaccgtacgtaacggtaaacgggaaacgggggaaacggggggaaacccgacggggaccggggtaacgttaacccgtaaacggttacccgttaccggtttacggaaccggttccggttaccggggg

SEQ ID NO: 332764 - DNA, 718 bp, Homo sapiens
  misc_feature: GZ8MTXP02IG8IP.8.34.D01.1.454.CMB.2.raw
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (421)..(421): a, c, t, g, unknown or other
  misc_feature (421)..(421): n is a, c, g, or t
tcagctcgcgtgtccacgaccggtgctcgatttagatcgtctgtgttgggtttgggtctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacgagagactctcgtgtgcagcctcgtggttcaccttnaagtaactacggcatgcacgtgggtccccncaaagccgtaccgaggaccgaaaaggggtntttaggggaggttggggtcgaccgtaaggttttgtttaccagttcgtggacgggctaggttcgttacaagttggttaancggactaacggtacgtcgggtaggaaacggtccgtactccgacactccgtacgaagaactaccaacgtaccgaagaaacctaaagtaaagttcggttaagttacggacgtacgtaacgaaacgtacgttaccgttaaacggtcgtaacgggaacggaaccggtaacgggtacgttaaaccgtaacgtaaacggtaacgggtaaaccggggaaaacgggggtacgggggaaaccggaacgggttaaccgggtaaacgtttaccggtaaaccgtttaccgttaccgtttacgggtaccg

SEQ ID NO: 332765 - DNA, 538 bp, Homo sapiens
  misc_feature: GZ8MTXP02FJ5VS.8.34.D01.1.454.CMB.2.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcncctacgtatcctggtaccaacagaaacctggccaggctcccaggcccctnatctatgtncatccaacagggccagtggcactcccagccaggttcagtcggcagtgggtatgggacagcttcactctcacatcatcancctgancctgagatgtgctagtttacttactgtanaacatccgtacgagtcggaccgtccgggggcctacgtttcggacccgttcgggaacccaaaggtacggaacgtactaacaaacgaaactcggtagcgtcgcaccagtcctgtactctac

SEQ ID NO: 332766 - DNA, 670 bp, Homo sapiens
  misc_feature: GZ8MTXP02IIIMN.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtggtccagccgtgggagtcacagagactctcgtgtgcagcctcgtggttcaccttcagtaactacggcatgcacgtgggcccaccaagcctccgaggcgaaggggattgggaggttggggtggctaggtttgtttcaacgttcgtaggacgggctaggttgttacagtttggtaatcggacgtaacgtccgtacccggtagggaaacgggtccgtaacttcccgaacctagttccctaccgaaggaacgtaaactaacgttaccgaaaggaaaccaaactaagttacgttaagttgggagtactagaaactacggtaccgtaaacgttcccgtaggacgaacgtacgggtacttaacgtaactaaccgtagggtaaacggaacgggggtaacgggggaccgaaggggtaccgggtaacgttaccgaagtttaccgttaccgtttacggaaccgg

SEQ ID NO: 332767 - DNA, 732 bp, Homo sapiens
  misc_feature: GZ8MTXP02GJJXI.8.34.D01.1.454.CMB.2.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaancgccacctctcctgcagggccagtcagatgtgcnctagtctctgacanagaactgcagctcccgacgccctnatctanggtcnacncaacgcggcctagtcgacacctcccgaagccgtaggttcaggtcggacgtagggttaggggtacgtggggaaccctagggtacctttaccgaaccttccacccgtaaacctacgtttacaaccgttaccgacggtaccccggtaggggacccgtacccggttaaggggaagggttacgttttagtttcgggtaacctttaaggtttttaactttacgttacgtaacctaaaacgtcgtttacccgggtaaaccggtacggttccgggggtccccgggttacccgggggtacccgttaaccggtttccccggggacccggtacgggggtaaaaccctaaaagggggtcgtaaaaccgttaacgttaaaccgaaaaccggttacgtaggtccggtacgtaacgtacccaactacgttcgttcgttaccttcgtaaccg

SEQ ID NO: 332768 - DNA, 668 bp, Homo sapiens
  misc_feature: GZ8MTXP02GD5DY.8.34.D01.1.454.CMB.2.raw
  modified_base (284)..(284): a, c, t, g, unknown or other
  misc_feature (284)..(284): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcatggtggagtcgtgggggagcgtggtccagccgtggggagtcacagagactctcgtgtgcagcctcgtggttcaccttcagtaactacggnatgctacgtgggtcccaccgaacgtcctaccgaggcgaaggggacttgggaggtggggtggacgtaggtttcgtttacagttcgtaggagggctaggttgttactagttgggtatggaccgaaggtacgtccgggtagggaacgggccgtaattccgaacctaactctaccgaagacgaactaaagttaccgaaagtaaccaaacaagttaggttaagttggaagtactaacgaaacgacgtaccgtaaacggtccgtagggaacggtaccgaacgggtaccgtaaagtaccggtaacgttacgggtaaacggaaacgggggacgggggaaacgaacgggacgggtaacgttaccgtaacgtaccgtttaccgttacggtacgg

SEQ ID NO: 332769 - DNA, 720 bp, Homo sapiens
  misc_feature: GZ8MTXP02HI923.8.34.D01.1.454.CMB.2.raw
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagcctgggagtcacagagactntcgtgtgcagcttctgggttcaccttnagtaactacggcatcgcacgtcgggtcccgccaaagcctaccgaaggaccgaaaaggggtctttggggaggttggggtcggactaggtttgtttcacgttcgtggaggggtctaggttcgttacaagttgggtaactggaccgtaagtacccgttaccggggtaggaaacgggggtcccgtaacgttacccgaccgtaacttcccgtacccgaaggaacgtaacctaaacgtttaccccgaaagggtaaacccaacgtaaagttacggtttaagtttacgggaagtaccgttacgaaaccgtacgtaccgttaaacggtcccgtaggaacgggacgtacggggtacgtaagtaccgtaacgtacggtaacgggaacggggtaacgggggaaccaagggtaccggggtaacgttaccgaaacggttaccgtttaccgtttaggtacccgg

SEQ ID NO: 332770 - DNA, 751 bp, Homo sapiens
  misc_feature: GZ8MTXP02F0F1D.8.34.D01.1.454.CMB.2.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (304)..(304): a, c, t, g, unknown or other
  misc_feature (304)..(304): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaagngccaccctctcctgcagggccagtcagaatgttggcnctagtatcctggtaccaanagaacctggcaggctcccgacgccctcatctagtggtncactccaagcggggccctacgtcggacctacgtcccgaacgtcccgtaggtttccgaaggtcgggactagggttaggggtactgggggaacctacgggtcctttaccaacttccgtacccaaccctattcccaaattccgaacggtcccgtagggtaacgcccgttagggaacggtagtttgggttacgtactttaaacgttttacttaaccgttcgttaaacctaaacgtacggttacccggtaaccgggtacgggttacccggggccccgggttaccccggggggtccccttaacccggtttccccggggtaccccggtacgggggtaaaccctaaaacggggttccggtaaacgttaacgtaaaccgaaaccggtaaacggttcggtaccggggtacctcggaaccctaaccgtacgttacctttcggttcccttacttacccg

SEQ ID NO: 332771 - DNA, 713 bp, Homo sapiens
  misc_feature: GZ8MTXP02FMULM.8.34.D01.1.454.CMB.2.raw
  modified_base (156)..(156): a, c, t, g, unknown or other
  misc_feature (156)..(156): n is a, c, g, or t
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttccncgttgctcttttaagaggtgtccagtgtcaagtgcaactggnggagtcgtgggggagcgtggtccagcctgggaggtcacagagactctcgtgtgcagcctntggttcaccttcagtaactcggcatcgcacgtgggtccncaagtcctccaggtcaaggggtattgggagtggggtgctaggtttcgtttcaagttcgtaggacggggctaaggttgttacagtgggtaatggacgagtaacgtccgtaggaacgggtccgtattccgaacctacgtacctaccgaacgtacgtaaacctaacgttacccgaaggtaaaccgtaaaccgtaaacgttaggttaacgtttacggggtaacggtaccgttacggtaaaaccgtaaccggaaccgtttaaacgtacccggtaggtaaacgggtaaccggtacggggtaccgttaaacgttaaccgtaaccgttacgggtaacgggtaaaacggggaccgggggaaaactaacggggtacgggtaacgttaccggtaaacgttacccgttacggtttacgtaacccgggg

SEQ ID NO: 332772 - DNA, 689 bp, Homo sapiens
  misc_feature: GZ8MTXP02JSEHE.8.34.D01.1.454.CMB.2.raw
  modified_base (294)..(294): a, c, t, g, unknown or other
  misc_feature (294)..(294): n is a, c, g, or t
  modified_base (373)..(373): a, c, t, g, unknown or other
  misc_feature (373)..(373): n is a, c, g, or t
tcagctcgcgtgtccacgaccggtgctcgatttagatcgtctgtgttgagctctgggagaggagcccagcactagaagtcggcggtgtttccattcggtgatcagcatgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctggttcaccttcagtaactacggcatgcactgggtccnccaagctccaggcaaggggacttgggagtggggtagctaggttgttcagtctgaggggcaggtgttacagtgggttacncgcgaacgtacgtacgggtacgggaacgggtaccgtacttaccgaccgtactacccgtaccgaacgtaacgtaacctaaacgttacccgaaacggtaaacctaaacgtaagttagttacgttacggacgtacgtacgaaccgtaacgtaccgttaacggtccgtaacggaacgggtaaccggtaaccgggtacgttaacaaaaccgttacggtaacgggtaaacggggaaacgggggaaaccgggggtaaaccgaacgggggtaccgggtacggttacccggtaacgtttacccggtaccggttacggaaaaccgg

SEQ ID NO: 332773 - DNA, 540 bp, Homo sapiens
  misc_feature: GZ8MTXP02H7HUG.8.34.D01.1.454.CMB.2.raw
  modified_base (156)..(156): a, c, t, g, unknown or other
  misc_feature (156)..(156): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttccncgttgctcttttaagaggtgtccagtgtcaagtgcaactggtggagtcgtgggggagcgtggtccagcctgggagtcacagagactctcgtgtgcagcctctgggtcaccttcagtaactacggcatgcacgtgggtcccnccaagctcccaggcaaggggnttgggagtgggtgctaggttgttcatcgtgagggcagtgttcagtggtatgcagactcgtagaacgggcgattcacatctacagacgacaacttcaagaacacaatgtattggagactagaacagactagtcctagagacgacgggagtactactacgtagtacggaagggacgggggaacaaggcggaacgttacgaagtaccgttacgtttacggtacgg

SEQ ID NO: 332774 - DNA, 553 bp, Homo sapiens
  misc_feature: GZ8MTXP02F64G6.8.34.D01.1.454.CMB.2.raw
  modified_base (268)..(268): a, c, t, g, unknown or other
  misc_feature (268)..(268): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctggggaggtcacagagactctcgtgtgcagcctntggttcaccttcagtaactacggcatgcactgggtccgccaagctccgaggcaaaggggattgggaggtggggtgcgagtttgttccagtctggagggcaggttgttcgaatggtatgcagactcgtagaggccatcacatcncagagacatccaaggaacanaatgtattgganctagacagacctaagtctaggaacggacgacggcgtaactacgtactaggtaacggaaggggaagggggaaccgaggacgggtacgtacgaacgtacgttacgtttacgg

SEQ ID NO: 332775 - DNA, 549 bp, Homo sapiens
  misc_feature: GZ8MTXP02FKNG0.8.34.D01.1.454.CMB.2.raw
  modified_base (322)..(322): a, c, t, g, unknown or other
  misc_feature (322)..(322): n is a, c, g, or t
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtctgggggaggcgtggtccagccctggggaggtcacagagactctcgtgtgcagccctctggggttcacccttcagtaactacggcatgcactgggtcccgccaagctccaggcaagggnttggagtggggtggcagttgtttcatctggaggcagtgttacaatggtatgcagactcgngagggcgatcaccatctcagagacaactacagaacaacaatgtattgganactagaacagacctaagtccgtagaggacgacgggacgtatacgtacgtaggtaacggaagggaacgggggaacagggaacggggagtaccgaacgtacttacgttcggacgtcggg

SEQ ID NO: 332776 - DNA, 807 bp, Homo sapiens
  misc_feature: GZ8MTXP02JMZN4.8.34.D01.1.454.CMB.2.raw
  modified_base (300)..(300): a, c, t, g, unknown or other
  misc_feature (300)..(300): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtggtccagccgtgggagtcacagagactctcgtgtgcagcctcgtggttcaccttcagtaactcggcatgcacgtgggtcccncaagctccgaggcgaagggattgggagtggggtgcgtaggttgttcatcgtggagggctagttgttactagttcgggtaatggcaggtccgtaccggtagggaaacggggcccgtaacgtttccaaccctacgttcccgtacccgaaaggtaaccgtaaacccgtaaacgtttacccccgaaaaggggtaaaaccctaaaccgttaaagtttacgggtttaaagttttacgggggaacggtaccgttaacggaaaaccgtaacccggttaacccgtttaaacggttacccggttaacggggaaaccgggtaacccgggtaaaccgggggttcccgtttaaaacgtaaacccgggtttaaaccggtaaacggggttaaaaccgggggaaaacggggggtaaccggggggtaaaacccggaacgggggtaacccgggggttaaacggtttaaccccggtaaaacgggtttaccccggtttacccggttttaacggggtaacccccgggg

SEQ ID NO: 332777 - DNA, 854 bp, Homo sapiens
  misc_feature: GZ8MTXP02GVCHB.8.34.D01.1.454.CMB.2.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacgagagactctcgtgtgcagcctgtggtcaccttcagtaactacggcatgcacgtcggtccncaagctccgaggacgaaggnttggagtggggtgctaggtttgttacagttcgaggaggggctaggtgttacaaagttgggtatggacgaacggtaccgttccgggtagggaaacggggtcccgtaacgtttcccgaaaccctacttaccgtacccgtaaggtaaacgtaaccgtaaacgtttaaccccgaaacgggtaaaaccctaaaccgttaaaacgttaacggttttaaagttttacggggtaaaccgtaccgttaaaccggaaaaccgtaaaccggtaaaccccgttaaaacggttacccccggttaaagggtaaaaccggggtaaacccggtaaaccgggggttaaaccggttaaaaccgtttaaacccggtttaaaccggtttaaaccgggggttaaaaccgggggtaaaaaccggggggtaaaccgggggggaaaaacccgtaacgggggtaaccgggggttaaaaccggtttaaccccgaaaacggggtttaaccccgtttacccggtttaaccggtaacccggggtttaccgggtaaccccgggggg

SEQ ID NO: 332778 - DNA, 509 bp, Homo sapiens
  misc_feature: GZ8MTXP02FTKOJ.8.34.D01.1.454.CMB.2.raw
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
  modified_base (404)..(405): a, c, t, g, unknown or other
  misc_feature (404)..(405): n is a, c, g, or t
  modified_base (421)..(421): a, c, t, g, unknown or other
  misc_feature (421)..(421): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagagcccaccctctcctgcagggccagtcagatgtgcnctacgtatctggaccaanagaactgccagctcccagccctnatctatggtncactccaagtacgggccacgtggcactcccgagccaggttccaggtcggactaggtgggtatcgggacagtcttcactctcacatnatcngctggcnctagagntgtnntattatactgtacaancttacgtacgagtcgaccggtccgggctacgtcgccgtagaccaaagtgatacacaactctcgtnctgacncatcgtctactgtaacc

SEQ ID NO: 332779 - DNA, 583 bp, Homo sapiens
  misc_feature: GZ8MTXP02FZPHZ.8.34.D01.1.454.CMB.2.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctcgtggttcaccttnagtaactacggcatgcacgtgggtccnccaagctccaggcaagggattgggagtggggtgctaggtttgttcagtcgtggaggggtcagttcgttacagtgggtatggctagactccgggtagacgggtcattcacatctaccagagacactaccgagaacacaattgtatttggagctagaactacgacctaacgccgtagacggacgtacgggtacgtaatacgtacgtacggtacggaaacggggtaacgggggaaccaagggaccgggtaacgttaccgaaacgttaccgtaccgttacggtaccgg

SEQ ID NO: 332780 - DNA, 573 bp, Homo sapiens
  misc_feature: GZ8MTXP02FX7VW.8.34.D01.1.454.CMB.2.raw
  modified_base (247)..(247): a, c, t, g, unknown or other
  misc_feature (247)..(247): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagngactctcgtgtgcagcctctgggttcaccttcaagtaactacggcatgcacgtcgggtccgccaagctaccgaggcgaaggggattgggaggtggggtggctaggttgtttccattcgtggagggtcagttgttcaaatggtatgcagacctcgtagacggccgatcaccatcctccagacgacaactaccgaaggaacacaatgtattggagctagaacagacctaagtccgtagaggacgacgggacgtacgtacgtacgtacgtaacggaagggacgggggaacgacgggacgggacgttaccgaagtaccgtacgtttacgg

SEQ ID NO: 332781 - DNA, 643 bp, Homo sapiens
  misc_feature: GZ8MTXP02HPU61.8.34.D01.1.454.CMB.2.raw
  modified_base (480)..(480): a, c, t, g, unknown or other
  misc_feature (480)..(480): n is a, c, g, or t
  modified_base (603)..(603): a, c, t, g, unknown or other
  misc_feature (603)..(603): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtggtccagccgtgggagtcaacagagactctcggtgtgcacgtcccttcgtggggttccacccttcgaaggttaaaccgtacgggcaagttcggaccgtaacgttccggggtaccccacccgaaacggtccctacccgaagggaccgaaaggggtacgtttaggggagggttggggtggtcgtaagttttcgttacagttccgtagggagggtctaggttgttacagtggtatgcagactcggaggaacggctattccaacgtntccgtacagtacgaactaactccgaagaacatatgtagttagatactagaactacgactaagccgtagacggacgtacggacttactacctagacggtacggaaacgggggacggggaaaccngggaaggtacgtacgacgtaccgtcgtttacggacgtcgg

SEQ ID NO: 332782 - DNA, 704 bp, Homo sapiens
  misc_feature: GZ8MTXP02GV1OV.8.34.D01.1.454.CMB.2.raw
  modified_base (332)..(332): a, c, t, g, unknown or other
  misc_feature (332)..(332): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccaggcctggggaggtcacagagactctcgtgtgcagccttcgtgggttccaccttcaagttaactacggcatgcacgtcgggtcccaccaagcctaccgaggacgaagggngttggaggtggggtgctagtttgttcagtcgtgggagggctaggttgttacgaagttgggtatcgacacggtaccgtccggtaaggaacgggtcccgtactacgtaccaactccaccaagaacgtactaaacgttaccgaaacggtaaacaaacgttaaagttagttaaagtttacgggaacgtacgtacgaaaaccgtaccgtaaccgttaaacggtccgtaacggaaacgggaccggtacgggtacgttaaactaccgtaacggtaacgggtaaacggggaaacggggtaacgggggaaaccggtacgggaccgggtaacgttaccgtaaacggttaccttaccggtacggtaccggtacggtaccgggg

SEQ ID NO: 332783 - DNA, 681 bp, Homo sapiens
  misc_feature: GZ8MTXP02GSREE.8.34.D01.1.454.CMB.2.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggagtcacagagactctcggtgtgcagcctcgtggttccaccttcagtaactacggcatgcacgtgggtccncagcctccgaggcaagggnttgggagtggggtgctagttgtttcacttgtggaggctagttgttacagttgggtaatgacagaccgttacggtaggaacgggtcgtacttaccgacctagtcctacccgaaggaacgaaccgtaacgttacccgaaacgggtaaaccaaacttaaagttacggtttaagtttacggggaactacgttaaacggaaactaaccggtacccttaaaacggtcccgtaggaacgggaaccgaacggggtaccgttaacgttaacgtaaccggttaggtaaacgggaaacgggggtaacgggggaaacccgaagggtaccgggtaacgttaccgaaagttacccgttcgtttacggtaacccgg

SEQ ID NO: 332784 - DNA, 749 bp, Homo sapiens
  misc_feature: GZ8MTXP02HFN0Y.8.34.D01.1.454.CMB.2.raw
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggagtcacagagactctcgtgtgcagcctcgtggttccaccttcagtaactacggcatgccacgtgggtcccnccaagcctccgaggcgaagggnttgggaggtgggtggctagttgtttcagttcgtggagggtctaggttcgttactagttcggtatgacgtacgtacgttcccgggtagggaaacggggtcccgtaacgtttacccaacccgtacttccccgacccgtaaacggtaacggtaaacccttaaaaccgtttaccccggaaaacgggtaaaaccctaaaccgttaaaacgtttacggtttaaagttttacggggaacgtaccgttaacgaaaccgtacgtaacccgttaaacggtaccccgttagggaaacgggtacccgtaacggggtaccgttaacgtaaccgttaaccggtaggtaaaccggggaacgggggaacgggggaaacccgtaaggggacgggtaacgttaccgtaaaacggttaccgttaccgtttacggtaacccgggg

SEQ ID NO: 332785 - DNA, 827 bp, Homo sapiens
  misc_feature: GZ8MTXP02HJWZ3.8.34.D01.1.454.CMB.2.raw
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (330)..(330): a, c, t, g, unknown or other
  misc_feature (330)..(330): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacagagactcgtcgtgtgcagcctcgtggtcaccttcagtaactacgnatgcacgtggtcccnccaagcctccgaggcgaagggtnttgggaggtgggtgactagtttcgttcattcgtggacggtctaggttgtacgagttggtatcgacgtaaggtaccgtccgggtagggaaaccggggtccctaacgtttacccgaacccgtagttacccgtacccggaaaggtaaaccgtaaaccgtaaccgttaacccgaaaacgggtaaaacctaaacgttaaacgtttacgggtttaaaggttagggtaaccggtaaccgttaacggaaaaccgtaaccgggttaaccccgttaaaacggttaccccggttaaggggaaaccgggtaaacccggtaccggggttaaaccgtttaaaccgttaaaaccggttaaccgggttaaaacgggttaaaaccgggggaaaacggggggttaaacccgggggaaaacccggtaacgggggtaaccggggttaaaacccggttaacccggttaaaacggtttaccccggtttacccgggttttaaccgggttaaacccggggg

SEQ ID NO: 332786 - DNA, 655 bp, Homo sapiens
  misc_feature: GZ8MTXP02FIZNO.8.34.D01.1.454.CMB.2.raw
  modified_base (182)..(182): a, c, t, g, unknown or other
  misc_feature (182)..(182): n is a, c, g, or t
  modified_base (313)..(313): a, c, t, g, unknown or other
  misc_feature (313)..(313): n is a, c, g, or t
  modified_base (524)..(524): a, c, t, g, unknown or other
  misc_feature (524)..(524): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgctcttttaagnggtgtccagtgtcaagtgcaactggtggagtcgtgggggaggcgtggtcccaggccgtggggaggtcacagagactctcgtgtgcagcctctgggttcaccttcagtaactacggcatgcacgtcggtccncaagctccgaggcgaagggtatgggacggttggggtggctaggtttgtttccagttctagggagggtcctaggttcgttacgaaagttgggtaatgtacgagaccgtcggtaggaaacggggccctaagttccaacctaatcctaccgaagacgaactaacttccgaaacgaaacaactaatacgttatttagggagtaccgtaggaaacncgtaccaagtacctaggaacggtacgacgggtacgttaacgtaacgtacgtacggtaaacggaagggggaacgggggaaccgaagggtaccggggtacgttacccgtaacgtaccgtttaccgtttaacgg

SEQ ID NO: 332787 - DNA, 614 bp, Homo sapiens
  misc_feature: GZ8MTXP02IHGRT.8.34.D01.1.454.CMB.2.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaggggaaanagcccaccctctcctgcagggccagtcagatgttggcnctacgtatcctggtaccanagaaacctggccaggctcccaggcccctnatctatggtncactacccaacgacggggcccaacgtggaccaactccccaggtcccaggttcaggtccggactagggtggggtatggggacagtcttnactctaccaccntacactcagccgtggacgccgtggaggtacttggttacgcgtaagtttacttacgtgtacctaacgtacgttccgtaacgtaggtcggcccggtaccgggggccttaccggtttccggcccgttacgggaaacctaaggtcggtaatactacgaaaacgtacgtacggtcgacgtaagacctaacgtactcgttacgtcttacgtacc

SEQ ID NO: 332788 - DNA, 669 bp, Homo sapiens
  misc_feature: GZ8MTXP02HSRK7.8.34.D01.1.454.CMB.2.raw
  modified_base (173)..(173): a, c, t, g, unknown or other
  misc_feature (173)..(173): n is a, c, g, or t
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagnggtgtccagtgtacaagtgcaacgtggtggaggtcgtggggggagcgtggtccagccgtagggaggtcacagagactctcgtgtgcagcctgtgggttcaccttcacgttaacacggcatcgcacgttgggcccnccaaagcctccagggcgtaaaggggattggggaggtggggtgtctagttgtttacagtcgtggagggctagtcgttanaagtggtntcgatacgacttccggaggaaacggggccctaacttccacctatcctaccaagtacgaaactaacgtaccaaggaaaccaactaacgttagttaagttgggtaacgtccgtaaggaaacctagggaacccttaaacggtccctaggaacggacgtaaccgggacgtaactaacgtacgtaacgtaacggggaaaggggacgggggaaaccgaggggaccgggtaacggttaaccgtaacggtacgttcgttacggtaccggtacggtcccggggg

SEQ ID NO: 332789 - DNA, 639 bp, Homo sapiens
  misc_feature: GZ8MTXP02J1U9O.8.34.D01.1.454.CMB.2.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaaggggaaagngcccaccctctcctgcagggccagtcagaatgtggcnctagtatccgtgtaccaacagaaacctggaccaggcctcccgacggcccctnatcctagtcgggtnctaactcccaaacgcgggcccacgtggacactccccgagccgtaggtcaggtcggacnggtggggatggggacaggtctcactcncacatccatcacgcctggacgtctagacggattgttgacttagtttacttacgtgtacactacgttcggtaccggagtcggacccgggttcccgggggacccttaccggtttccgggacccgtacggggaacccgtaaaggtcgggtaaacgtaacgtaaaccgtaaacggtaaccgttgggtaccggtaccgttaacgacccgtaaccttacgtccgtttcgttacccgtttctacccg

SEQ ID NO: 332790 - DNA, 823 bp, Homo sapiens
  misc_feature: GZ8MTXP02IKG7E.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtgggtggaggtcgtgggggaggcggtggtccagccgtaggggaggtcacgagagtactcgtcgtgtgcagcctcgttggttcctaccttcaagtaactacggctagtcgcctacgtcgggtcccgccgaacgccgtaccgagggacgtaaaggggtgttaggggtacggtggggtacggtacgttaggtttacgttttcgacgttccggttagggaacggggtacgttaggtttacggtttaacgtaagggttcgggttaataccgggaccgtaaccggggttacccggtaccggggttaacggggaaaccggggtaccctaaacgtttacccgaaccctacttacccgtacgaaacggtaacgtaaccgtaaaccttaccggaaacggaaacctaaaccgttaaagttacggtttaaggtttcgggaacgttaaccgtaagaacgtaacggttaccgtaaacggttccgtaagggacggtaaccggtaacgggtactttaaaaccgtacgttaaacgggtaacgggtaacggggaaaacgggggacgggaaaccggaacggggtacccggggttaacgttaacccggtaaacggtttcccgtttacggtttaacggtacccgggg

SEQ ID NO: 332791 - DNA, 672 bp, Homo sapiens
  misc_feature: GZ8MTXP02I2QSE.8.34.D01.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
  modified_base (372)..(372): a, c, t, g, unknown or other
  misc_feature (372)..(372): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgttcttcgtctccgaggggaaagacgcccaccctctcctgccagggccagtcagaatgttggcncctagtntcctgacaanagaactgcagcnccngcccnatcatgtncatcaacgnggccagngcncncccngcctaggtcaggtcgacgtgtgggtatgggacagtcttcactccacaccnctcatcacgtccgtagggacgtccgttggaagtgtttcggttacgtacgttaagttttacgtttaccgttcggttaacctaaacgttacggtttacccggtaaccgggttacggtcccgggttaccccgggtcccggggggttacccttaacccgggtttccccggggaccccgtttaacggggaaaccccgttaaagggtcgggttaaaccttacgttaaaaccgtaaccgtaacggttcggttaacggccgttaacggacctaccgtacggttacttcggtcctttaccgtttacccg

SEQ ID NO: 332792 - DNA, 590 bp, Homo sapiens
  misc_feature: GZ8MTXP02GAOMR.8.34.D01.1.454.CMB.2.raw
  modified_base (157)..(157): a, c, t, g, unknown or other
  misc_feature (157)..(157): n is a, c, g, or t
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttccncgttgctcttttaagaggtgtccagtgtcaagtgcaacgtggtggagtcgtgggggagcgtggtccagccgtgggagtcacagagactctcgtgtgcagcctgtggtcaccttcagtaactacggcagtcgcacgtgggtcccnctaagcctccgaaggcaaggggtnttgggagtggggtgctagttgttacagtcgtgagggcagtcgttacagtgatgacagactcggagacggcatcacntcncananacatacagacacatgtagttgagtctagacagaccgttaacgtcgtagacggactaaccggggacttaaacgtaccgttaaacggtacggtaaacgggaaacgggggacgggggaaaaccgaaggggtaaccggggtaacgttaacccgaaggtttacctacccggtttaggtaacccggg

SEQ ID NO: 332793 - DNA, 720 bp, Homo sapiens
  misc_feature: GZ8MTXP02H7B74.8.34.D01.1.454.CMB.2.raw
  modified_base (166)..(166): a, c, t, g, unknown or other
  misc_feature (166)..(166): n is a, c, g, or t
  modified_base (174)..(174): a, c, t, g, unknown or other
  misc_feature (174)..(174): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttnttttaagnggtgtccagtgtcaagtgcaacgtgggtggagtcgtgggggagcgtggtccagccgtggggagtcacagagactctcgtgtgcagcctntggtcaccttnagtactcggcatgcacgtgggtccncaagcctcgaggctaagggnttgggaggtgggngtctaggttcgtttcattcgngagggtctagttggttacagttggtatcgacagtaccgtcggtaggacggggctacttcgacctatccgtaccaggtacaactaacttacccgaaggtaaaccacgtaaagttcggttaagtttaggggactacgtaaggaaacctacggtaacccgttaaaacggttcccgtaagggaaacgggtaacccggtaacggggttaccgggttaaacttaaaccccgggttaaagtaaccgggggtaaaacccggggtaaaaggggggaaccggggggtaaaacccgaacgggggtacccgggggttaaacgtttaccccgggaaaacggtttcccggtttaacccggttttacggggtaaccccgggg

SEQ ID NO: 332794 - DNA, 758 bp, Homo sapiens
  misc_feature: GZ8MTXP02IL14E.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctgttgctcttttaagaggtgtccagtgtcaagtgcaacgtggtggagtcgtgggggaggcgtggtccagccgtgggagtcacagagactctcgtgtcgcagccttcgtgggttccaccttcagtaactacggcatgccacgtcgggtccgaccaagcctaccgaggacgaagggtagttgggaggtgggtggctaggtttgttccagttcgtaggagggctaggttcgttacgtagtggtatcgacctagaccgttccggtaggacggccgtactacaccgtactctaccgaagtacgaaactaacgtacgaaacggaaactaaacgtaagttagttaagtttacgggaacgttaccgtaacgtaaaccgtaacggtaaccgttaaacgttaccgtacgggaacggtaaaccggtaccggggttacgtaaaccgttaaaccggttaaacccggttacggggtaaaaaccgggggtaaacgggggtaaaaccgggggggtaaaacccgtaacgggggtaaacccgggggtttaacccgggtttaaaacccggttaaaccggttttaaccccgtttaaccggttttaacccggggg

SEQ ID NO: 332795 - DNA, 715 bp, Homo sapiens
  misc_feature: GZ8MTXP02JU0OM.8.34.D01.1.454.CMB.2.raw
  modified_base (461)..(461): a, c, t, g, unknown or other
  misc_feature (461)..(461): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcggtggtccaggccgtgggaggtcacagagactctcggtgtgcagtcctcgttcgggttcaccttcaagtaacctcggcatcgcaccgtcggggtcccaccgaacgcctccgaagggcgaaaggggtatttggggagggtggggtacggcgtaggtttcgtttacagttcgtgggacggggtctaggtcgttatagtgggtaatgcgagtaccgtcggtaaggaaacgggtccgtattccgacctntccctacagacaactaacttaccgaaaggtaaacacgttaagtcgtttaaagtttgggaacgtacgtacggaaacctacggtaaaccgttaacggtaccgttagggaacggaaccgtaacgggggtacgttaaactaccggtaccggtaagggtaacgggaaaacgggggacgggggaaacccgtaaggggtaccgggggttaacgtttacccggaaaccgtttaccgttacccggtttaggtaaccccggggg

SEQ ID NO: 332796 - DNA, 562 bp, Homo sapiens
  misc_feature: GZ8MTXP02IGWDL.8.34.D01.1.454.CMB.2.raw
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgagggggaaagagccacctctcctgcagggccagtcagaatgtgcgcctacgtatcctggtacaacagaaacctggccaggctcccaggcccctcntcatggtgcatccaacagggccaacgtcggcacgtcccagccctaggttcagtcggacagtgggtatggggaacaggcttcatcctanaccatcatcagcctggagcctgagtatgttncgtagttattacgtntacaaacgtatacgtacgaggtcggccggtaccgggggacctacgtttccggcccgttgggaaccctaaggtaggactagtacgaaacgaacgttcgttaggacgtgtaccactacttctcgttcttactcc

SEQ ID NO: 332797 - DNA, 646 bp, Homo sapiens
  misc_feature: GZ8MTXP02JV9CM.8.34.D01.1.454.CMB.2.raw
  modified_base (263)..(263): a, c, t, g, unknown or other
  misc_feature (263)..(263): n is a, c, g, or t
  modified_base (331)..(331): a, c, t, g, unknown or other
  misc_feature (331)..(331): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtgggtggagtcgtggggggagcgtggtccagccgtgggagtcacagagactctcgtgtgcagccctntagggttccaccttcagtaactcggcatgcacgtcgggtcccaccaagcctccgaggacgaaggggtnttgggaggtggggtaggcttaggttgttttcattcgtaggacggggctagttggtacagttggtactggcaggtacctcggtaggaacggtcgtacttccacctacgtccaccgagaacgaacctaacgttaccgaaaggaaccaacgtaattaggttacgtttaggagtcgtagtaaacgactaccgtaagttccagggtagtaccgacggtcgtactacgtacgtagtaacgggaaggggaacgggggaacccagggtacggtaacgttacccggtaagttccgttacgttacggtacgttcgggtacccggg

SEQ ID NO: 332798 - DNA, 697 bp, Homo sapiens
  misc_feature: GZ8MTXP02FYMJ2.8.34.D01.1.454.CMB.2.raw
  modified_base (301)..(301): a, c, t, g, unknown or other
  misc_feature (301)..(301): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacgagagctcgtcgtgtgcagcctcgtgggttcaccttcagtaactacggcagtgcacgtggtccnccaagcctaccgaggcaagggtattgggaggttggggtgctagtttgttcagtccgtggagggctagtgttacagtggatgacacgctcggtagaacggcgtacttcacctagtacctaccgagacgtaactaacgttacccgaaaggaaacaaaccgtaaagttacgttaaacggtttagggagtaccgttaagaaacccgtacggtacccgttaaacggttccggttacggaacgggacccgtaacgggggttacctaacgtttaacgtaaccggtaaggggttaaaccggggaaagggggttaaaaccggggggaccgtaacgggggaaccgggtaccggtttaaccgaaaccggtttaccgttacggttttaccggaccgggtttaccgggg

SEQ ID NO: 332799 - DNA, 743 bp, Homo sapiens
  misc_feature: GZ8MTXP02JCBEZ.8.34.D01.1.454.CMB.2.raw
  modified_base (332)..(332): a, c, t, g, unknown or other
  misc_feature (332)..(332): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtggggagcgtggtccagccgtgggagtcacgagagactcgtcgtgtgcagtcctcgttgggtaccaccttcagttaacgtcggcatgaccacgtcgggtcccacaagcctacgaggacgaagggtntgggaggtgggtgcttagtttcgttcagtcgtaggacgggctaaggttcgttacaagttggtatcgacgtaacggtaccgttccgggtaaggaaaccggggtccctaaactttacccgaaccctaacgtaccgtacccgaaacgtaaacgtaacctaaacgttaaccgaaacggtaaaccctaacgttaaagtttacggttaacggtttagggacggtaccttaaacgggaaaaccttaccggtaaccttaacgggttacccgtaaagggacgggtaaaccgtaaccggggtacttaaaacgtaccgttaaacggtacggaaacggggtaaacggggacggggtaaacacgggtacggtaacgttacgaaacgtttaccgtacggtttacggaccgtttacggtaccgggg

SEQ ID NO: 332800 - DNA, 565 bp, Homo sapiens
  misc_feature: GZ8MTXP02HAQOZ.8.34.D01.1.454.CMB.2.raw
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagccgtgggaggtcacagagactctcgtgtgcagcctctggtcaccttcagtaactacggcatgcacgtgggtcccnccaagcctccaggcaagggattgggagtgggtgctagttgtttcagttcngagggcagtgttcagtgtaatggacagactcggtgaaggccgtatcaccanctcagacgacaatccagaacacaatgtatttggagtctagaacagtacctaaagtccctaggaacgacgtaacgggcgttactaacgtaactagggaacgaaaggggacgggggaaaccgaaggacgggtaacgttccaaaggtaccttacccgtttggtaccggg

SEQ ID NO: 332801 - DNA, 585 bp, Homo sapiens
  misc_feature: GZ8MTXP02FN1VY.8.34.D01.1.454.CMB.2.raw
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (284)..(285): a, c, t, g, unknown or other
  misc_feature (284)..(285): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
tcagctcgcgtgtccacgaccggtgctcgatttagatcgtctgtgttggggtttgggggaggaactgctcagttaggacccagagggaaccatgggaagccccagctcagcttctcttcctcctgctactctggctcccagtttcagataccaccggagagattgtgttgacacaatctccagccaccctgtcttcgtctccgaaggggaaancgccaccctctcctgcagggccagtcagatgtgcncctagtncctgtacacagaacngcagcnccagcctnntctanggncatccanaggcacgtgacactcccancctaggtcagtcgcagtgggtanggcagctcactcncacatcatcagtcctaggacncgtagaggtntagtgtagttagtttacttacgtgtacaactacgttacgtacgacggtccggtcccgggtccggggtacccttacgggttcccggaccgtacgggtaaccgtaaaacggtcggtaaactaacgtaaaccgtaaaacgtacgttcggtacgtaccgtaacgaccgtaacctacgttaccgtacgtttaccttaacgtacc

SEQ ID NO: 332802 - DNA, 708 bp, Homo sapiens
  misc_feature: GZ8MTXP02IX6K9.8.34.D01.1.454.CMB.2.raw
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaatggtggagtcgtgggggagcgtggtccagccgtggggaggtcacagagctctgtgtgcagcctgtggtcaccttnagtactacggcatgccacgtgggtcccnccaagcctccaggcgaaaggggtattgggaggtggggtggcttaggtttcgtttcagttccgtaggacggggtctaggttacggttacaaggttgggttattacggaccgtaacggacccgtttcgggtagggaaacgggggtccctatttacccaccgtaatttcccgtaccgaggaacgtaactaaacgttaccgaacggtaaaactaccgtaaagttacggttagtttagggacgtacgtaaacgaaccgtacgtaccgttaaaacggtcccgtaagggacggaccgtaaccggggtacgttactaaccgttacggtaacgggtaacgggaaacgggggaacgggggtaaaccgaaggggtaccgggtacgtttaaccgacggtttaccttccggtttacggtaccggg

SEQ ID NO: 332803 - DNA, 617 bp, Homo sapiens
  misc_feature: GZ8MTXP02H9GMT.8.34.D01.1.454.CMB.2.raw
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
tcagctcgcgtgtccacgaccggtgctcgatttagatcgtctgtgttgggtttggggagctctgggagacgagcccagcactagaagtcggcggtgtttccattcggtgatcagcactgaacacagaggactcaccatggagttttgggctgaacgttgggttttcctcgttgcttctttttaagaggtgtccagtgtcaagtgcaacgtggtggagtcgtgggggagcgtggtccaggccgtgggaggtcaacgagacgactcgtcgtgtgcagccttcgtggtccacttcaagtaactacggnatgcacgtcggtaccnccaagctaccgaggcgaaagggnttagggagtggggtcggtactaggtttntttcccgatcgtggagggctagttgtacaagtgtangacgagactcgagacggccatacacgntcncgaagacgaactactaccgaaggaaaccaagtaagttagtagttggactacgtaggaaacagtaccgtaacgtaccgtaggaacgacgtacgggtactaaactacgtacgtacggtaaacggaagggaaccgggggaaacgcggacggtacgtaaccgtacgttaccgtaacgttacgg

SEQ ID NO: 332804 - DNA, 624 bp, Homo sapiens
  misc_feature: GZ8MTXP02IIUQU.8.34.D01.1.454.CMB.2.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggaggtcacagagactctcgtgtgcagcctcgtggtcaccttcagtaactacggcatgcacgtgggtcccncaagcctacgaggcaagggtnttggaggtgggtgctagttgttcatcgtggaggtcagttgttacaagttggtatgacacgtacctccggtagaaacggtccgattccacctacgtctacgagtacgactaactaccgaagaacaactaatcgttaagttggagtcgtacgaaacgacgtaccgtaaacgtccgtaggaacgaccgacggtacgtaactaacgttgaacgtaaaccgggaaggggaaaccgggggaccgaagggtacgggtaacgttacccgtaaaggttacccgttacgtttacggacggttaccggtaccggggg

SEQ ID NO: 332805 - DNA, 686 bp, Homo sapiens
  misc_feature: GZ8MTXP02GNBFI.8.34.D01.1.454.CMB.2.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (306)..(306): a, c, t, g, unknown or other
  misc_feature (306)..(306): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaanacgccaccctctcctgcagggccagtcagatgttggcnctacgtatccgtggtaccaacagaaacctcggaccaggcctacccgacggccccctanacttctagtggtcgacactaccgaacgacggggcccaacgtcggaccacgtccccgaggtcccgtagggttccaggtccggcgtaggggtcggggtagtacggggactagggtaccttccacttcctaccactactccactaccgacggtcccgtgggaacctccgtagggaaggttcttggttacgtactttaagtttacttacgtgtaactaacgtacgttaccggtaccggtacgggtcccggtacccggggtacccgggggtcttaacccgggtttcccgggacccgttagggggaaacctaaagggtcggtaaatacgtaaaaccgaacggtaacgtggtacggactaacgacacgtacttcgtctactcgtacc

SEQ ID NO: 332806 - DNA, 712 bp, Homo sapiens
  misc_feature: GZ8MTXP02FXA6T.8.34.D01.1.454.CMB.2.raw
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggaggtcacgagagactctcgtgtgcagcctcgtggtcaccttcagtaaccacggcatgcctacgtcggggtcccnccaagccaccgaggacaaggggtnttgggaggtggggttgcgttagtttcgtttacagttcgtagggaggggtactaggttggttacaggttggtaatcggacgacggtaccgtccgggtaaggaaaccggggtcctaacttaccacacttaccacgaacgtaagtaacctaacgttacccgaaaggaaacctaaacgtaaagttacgtagtttacggagtacgtaacgaacgacgtaccgttaaacggtcctaaggggaaccggtaaccggtacggggtaacttaacgtaaaccgttaaccggttaaggggtaaaccgggtaaagggggaaccgggggtaacctaacgggggtaccggggtaacgttaaccggtaaagttacccgtttccgttacggtacccgggg

SEQ ID NO: 332807 - DNA, 771 bp, Homo sapiens
  misc_feature: GZ8MTXP02G52CU.8.34.D01.1.454.CMB.2.raw
  modified_base (290)..(290): a, c, t, g, unknown or other
  misc_feature (290)..(290): n is a, c, g, or t
  modified_base (553)..(553): a, c, t, g, unknown or other
  misc_feature (553)..(553): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttggctgaacttgggttttcctcgttgctcttttaagaggtgtccagtgtcaagtgcaacgtggtggagtcggtgggggaggcgtggtccagccgtgggaggtcacagagtactctcgtgtgcacgcctcgtggttccaccttcaagtaactcggntatgctacgtcggtccaccaagcctaccgaggacgtaagggtgtttgggaggttgggtaggcgttaggttttgtttacgacgttcggtggtacggggactaggttacgttacgtaagttgggtaagttcggaccgtaacgggtaccgtacccggggttaagggaaacccggggtcgtaacttacccgaacctactccctacccgagaacgtaactaacgttaccaaaggtaaacctaataagtacggtttatttacggggaancgttaaacgaacgtacgtaacccttaaacggtcctaaggggaaaccgtaaccggtaacccgggtacgtttaaacgttaacccggaaacggtttaagggtaaaacccggggggaaacgggggtaaaccgggggaaaaccgtaacggggtacggggtttaaaccggttaaccggtaacccgtttaccccggtttaccgggttaacggttaaccccggggg

SEQ ID NO: 332808 - DNA, 698 bp, Homo sapiens
  misc_feature: GZ8MTXP02GZ1GS.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagccgtgggagtcacagagctctcctgtgcagtcctcgtggttcaccttcagtagctacggcagtcgcacgtcgggtcccgacccaaacgtccgaggacgaaaggggtattggggaggtggggtcgcgtaggtttcggtttcagttccggtaggacggggtctaggttcgttacgtaagttcgggtaaacgttcggaccccggtacgggtcccggttagggaaacggggacccgtattacccgaacctacgttccgtacccgaagaccgaacctaaacccgtaccgaacggtaaaccaaactaagttacgttacgttacggacctagaacctacgtacctaacgtccgtaaggacggtaacgtacgggtagttaactacgtaacgtacggtaaacgggaaacgggaacgggggaacacgggacgggtaacgtaccggtaacgttaccgtcgtttacggacccgttggtacccgggg

SEQ ID NO: 332809 - DNA, 787 bp, Homo sapiens
  misc_feature: GZ8MTXP02ILV8E.8.34.D01.1.454.CMB.2.raw
  modified_base (277)..(277): a, c, t, g, unknown or other
  misc_feature (277)..(277): n is a, c, g, or t
  modified_base (351)..(351): a, c, t, g, unknown or other
  misc_feature (351)..(351): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactgggtggagtcgtgggggagcgtggtccagcctgggagtcacagagactctcgtgtgcagcctctggttcaccttnagtaactacggcagtgccacgtcgggtccgccaagcctacccgaggtccaaaggggtatttggggagttggggnggtccaggtttgttttccaattcgtaggacggggctaaggttcgtttaccgaatttgggtaattggaccctaaggtaacctccggggttaacgggaaagggggtacccgaacgtttacccgaaccccgtagttacccttacccggtaaagaacggtaaactaaaactttaccccgaaagggtaaaccaaacctaaaagttacggtttaagttttagggaacggtaccttacgggaaaaccacgggtaacccttaaacggtcccgttacgggtaaaggggtaaacccgaaaacccggggggtcttaaaacgttaacccgtttaaacggaacggttaaccggggaaaagggggtaccggggggaaaaccccgtaaggggacccgggggtaaggtttacccgaaaacgtttccggttaccgttttacgggtaaccccgg

SEQ ID NO: 332810 - DNA, 712 bp, Homo sapiens
  misc_feature: GZ8MTXP02GRQ7E.8.34.D01.1.454.CMB.2.raw
  modified_base (419)..(419): a, c, t, g, unknown or other
  misc_feature (419)..(419): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggaggtcacgagagactcgtcgtgtgcagcctcgtggtccaccttcagtaactacggcatgctacgtcgggtccccacgaacgccgtacccgaaggggcgtaaaggggtgtttaggggaggttggggtcggcttaaggtttcgtttacagttcgtagggaggtactaggtttagttacgagttgggtntacgcgaacgtaccgtccggtagggaaccgggccgtaaactccctaaccgtatacccgttacgaacgaacgtaacctaaacgttaccgaaacggtaaaacctaacgtaaagtttcggtttaaaggtttacggaacgggtaacctacggaaaactcggtaaccgttaacggtcccgtaaggaacggaccgtaacgggtcgttaactaaacgtacgtacggtaaacgggaaaggggaacggggaaccgaacgggacggtacgtaaccgtagttaccgttaccgttaggtacccgg

SEQ ID NO: 332811 - DNA, 724 bp, Homo sapiens
  misc_feature: GZ8MTXP02G45G7.8.34.D01.1.454.CMB.2.raw
  modified_base (208)..(208): a, c, t, g, unknown or other
  misc_feature (208)..(208): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgngggggagcggtggtccaggccgtgggaggtcaacgagagactctcggtgtgcagcctcgtggttccaccttcagtaaactacggctatcgacacgtcggggtacccncgaacgcctaccgaggcgaaagggtnttagggagtggggtggctaggtttgttacattcgtggacggctagtntacaagttggtatgactagtaccgtaccgtaggaacggggtccctacgttccaacctactacctacccgaaacgaacgaaccttaaacttacccgaaacggtaaacctaacgtaaagttagttaaccgtttaggaacgtacgttacggtaaaaccgtaacgtacccgttaaacgtccgtaacgggaacgtaaccgaaaccggggtacggttaacttaacgtaacggtaacggttaaacgggaaaacgggggtaccgggggaaaaccacggggtaacgggtaacgttaccgaaacgtttaccgttaccggtttacggaccgttacgggtaaccgggg

SEQ ID NO: 332812 - DNA, 704 bp, Homo sapiens
  misc_feature: GZ8MTXP02JEBJF.8.34.D01.1.454.CMB.2.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctcgtggtcaccttnagtaactcggcatgacactgggtccnccaagctccaggcaaggntgggaggtgggtggctagttgtttcagtctgagggcagtcgttcaagttggtatgcgtagaccgtccgtaggaaacggggcccgtattccgaaccctagtcctaccgaagtacgaactaaacgttaacccgaaacgggaaacctaaaccgtaaacgttaggttaaagttttgggaacgtacgttaacggaaacgtacggtaacccgtaaggtaccgttacgggaacgggtaaccgtacggggtaccgtaacgttaaccgtacggttacgggtaaacgggaaacgggggtaacggggggaaaacccgaacggggtaaccggggtaaccggttaacccggtaaacggttaaccgttaccggtttacggaacccggtttcgggttaccggggg

SEQ ID NO: 332813 - DNA, 618 bp, Homo sapiens
  misc_feature: GZ8MTXP02F03XG.8.34.D01.1.454.CMB.2.raw
  modified_base (304)..(304): a, c, t, g, unknown or other
  misc_feature (304)..(304): n is a, c, g, or t
  modified_base (502)..(502): a, c, t, g, unknown or other
  misc_feature (502)..(502): n is a, c, g, or t
  modified_base (578)..(578): a, c, t, g, unknown or other
  misc_feature (578)..(578): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcggtgggggagcgtggtccagccgtgggagtcacgagacgtactcgtcgtgtcgcacgtcccttgtcggttaccacccttacgacgtaaccgtacggntagtcgacaccggtcggtccccgacgacgccgtaccgaggcgaaaggggtgtggaggtgggtgcgttagtttgttacacgtcgtaggacggtctaggttgttacagttgggaactggacagtaccgtacgtaggaacggtccgtattccactatcctacgagacgaactactacgaagaacatacgtagtagtagagntacgaacgtacacgtacgtcgaggacgacgacggacgtatacgtaggtacgtacgggaaacggggcgggaaaccgngggacggtacgtacgtaagtttccgtcgttacggtaccgg

SEQ ID NO: 332814 - DNA, 601 bp, Homo sapiens
  misc_feature: GZ8MTXP02F8RWJ.8.34.D01.1.454.CMB.2.raw
  modified_base (269)..(269): a, c, t, g, unknown or other
  misc_feature (269)..(269): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtggtccagcctgggagtcacagagactctcgtgtgcagcctctggttcaccttnagtaactacggcatgcacgtcgggtaccaccaagcctaccgagggacaaaggggtatttgggagtggggtgcgtaggtttgtttcagttcgtaggaggggtctaggttgttacagtggtatgacagaccgtcggtaggaacgggccgtattcaccatcctacagacgacaactaccaaggaaacaacaagtgttattggagtctacgaacagacctaagtccgtaggacggacgacgggactatacgtacgtacggtacggaaacggggacgggggaaaccgaagggacgggtaacgttaccgtaacgttacgttaccgtttacggtaccgg

SEQ ID NO: 332815 - DNA, 759 bp, Homo sapiens
  misc_feature: GZ8MTXP02FMR0P.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggaggcgtggtccagccgtggggaggtcacgagagactctcgtgtgcagcctcgtgggttccaccttcagtaactacggcatgctacgtcgggtcccaccgaagcctaccgaggacgaaggggtattgggaggtggggtggacttaggtttgtttcagttcgtaggacggggtctaggtttgtttacaaggtttgggtatcgacgtaaacgtacccgttccgggtagggaaacggggtcccgtacgtttacccacccgtaacgttcccgttaaccgaaacgtaaacgtaaacctaaacgtttacccccggaaaagggaaaaccctaacgtaaagttaaggtttaaacgtttggggaacgtaccgttaacggaaaaccgtaccgtaacccgtttaaacggtcccgttaggaaccggtaccgggtaccgggtaacgttacgttaacgtacgttacggtaaagggaaacgggggacgggggaaaccgaggggtaccgggtaagttaacccgaacggttaccgttaccggtttacgacggttcggtaccgggg

SEQ ID NO: 332816 - DNA, 629 bp, Homo sapiens
  misc_feature: GZ8MTXP02G2R7Q.8.34.D01.1.454.CMB.2.raw
  modified_base (251)..(251): a, c, t, g, unknown or other
  misc_feature (251)..(251): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctggggagtcacagagactctcgtgngcagcctcgtcgggtccaccttcagtaacacggcatgcacgtcgggtcccaccaagcctacccaggccgaagggtatggaggtgggtgctagttgttcatccgtggaggcagttgtacaagttggtatgacgagtacctcggtaggaaaccgggtcgaacttcaaccctatcctaccagacacgtaactaccgaagaaaccactaagttagtagttgagtacctagaaacgacgacctaagtccgtggaggaacgacgggtactacgtaacccgtagttacggaaacggaaagggggaacgggggaaacctaggggtacggggtaacgttacccgaaagttacccgttacggttacggtacgttcgggtaacccgggg

SEQ ID NO: 332817 - DNA, 666 bp, Homo sapiens
  misc_feature: GZ8MTXP02JF2X2.8.34.D01.1.454.CMB.2.raw
  modified_base (626)..(626): a, c, t, g, unknown or other
  misc_feature (626)..(626): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacgagagactcgtcgtgtgcagcctcgtggttcaccttcagtaactcggcatgcacgtcgggtcccaccaagcctaccgaggacgaaggggtattgggaggtggggtgctaggtttcgtttcagttcgtagggacgggtctaggttgttacaggttggtattcggactaaggaccgttcccgggtagggtaaaccgggggcctaacgttaccaacccgtactccctaccgagtaacgaacctaaacgttaccgaaacggaaacctaactaagttagtttacgttagggaactcgtaacgaacgtacgtacccgtaacgttccgagacggacgtacggggtacttaacgtaacgtacgtacggaaaccgggaaaggggacggggaaacgnggacggtacgtaccgtacgttaccgtcgttacggtaccgg

SEQ ID NO: 332818 - DNA, 534 bp, Homo sapiens
  misc_feature: GZ8MTXP02JBWAG.8.34.D01.1.454.CMB.2.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagcctgggaggtcacagagactctcgtgtgcagcctctggttcaccttnagtaacctacggcatgcactgggtccnccaagctaccgaggcaacgggntttgggaggtggggtggctagttntttcattcgtgaggggctagtgtcagtgtactgcagactccgtgaagggccattcaccatcacanagacaatacagaacanaatgtattggagctagaanagacctaagcctagagcgacggcgtatacctagtacgtaacgacgggacggggaaccaaggacggtacgtaccagtactccttagaccg

SEQ ID NO: 332819 - DNA, 658 bp, Homo sapiens
  misc_feature: GZ8MTXP02FKJJM.8.34.D01.1.454.CMB.2.raw
  modified_base (272)..(272): a, c, t, g, unknown or other
  misc_feature (272)..(272): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtgggagtcacgagagactctcgtgtgcagcctcgtggtcaccttnagtactacggcatgcacgtcgggtcccaccgaacgcctaccgaggacgaaggggtgttgggaggtggggtcgctaggtttcgtttcagtcgtaggagggtctaggttgttacagtgggtatgactagaccgtcggtaggaacgggcctattccaaccgtatccctacgagaacgaactaacgttacccgaaggtaaacactaaagttgttaagttagggaacgtctaacgaaaccgtacgtaaccgtaaacggttccgtagggaacgggtaccgtaacggggtacttaataaccgtacgtacgggtaaacggggaacgggggaacgggggaaaccgaagggacgggtacgttaccgaacgttaccgttaccgttacggtacccggg

SEQ ID NO: 332820 - DNA, 709 bp, Homo sapiens
  misc_feature: GZ8MTXP02ICILM.8.34.D01.1.454.CMB.2.raw
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttggctgaactgggttttcctcgttgctcttttaagaggtgtccagtgtcaagtgcaacgtggtggagtcgtgggggagcgtggtccagccgtgggagtcacagagactctcgtgtgcagccttctgggttcaccttcagtaactacggcatgcactcgggtccaccaagcctaccgaggcgaaggggtagttggaggtcggggtgctaggtttgtttcccagtctggaggctaaggttgttcgaagttggtacgttgccgtaaggacgttcccggtaggaacgggcccgtaattccaactactcctaccgaagtaacgaactaaactttccgaaacggaaaccaacgtaaagttacgttaaacgtttacgggaacgtacgttaaacggaacgtacggtaacccgttaaacggtaccgttacggaaccgggtaacggaaaccggggtcgttaaacgttaccgtaacggttacgggtaaaaccggaagggggaaaccggggggaaccgtaacgggtacgggggtaaccgtttaacggaaccgtttaccgtttacccgtttaacgggg

SEQ ID NO: 332821 - DNA, 763 bp, Homo sapiens
  misc_feature: GZ8MTXP02HOLAV.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttggctgaacttgggttttcctcgttgcttcttttaagaggtgtccagtgtcaagtgcaactggtggagtcgtgggggagcgtggtccaggccgtggggagtcacagacgtacttcgtcgtgtgcagtccctgtagggttccaccttcgaagttaactaccggctagtcgaccacgttcggggtaccccacccgtaaaggtccctaccccggaaagggtaccggtaaaagggggttactttagggggtaaagggtgggggttacggtacccgtttaaggttttcggttttacaccgttccggtagggtaacggggtctaggtttacgttaacgaaggtttcgggtaatacgtactaaacggggtacccgtccgggttaaagggaaacggggtaccctacgtttacccaaccctacgttacccgtaacccgaagtaacgaaactaaacgttacccgaaacggtaaaccaaaccgttaattacgggtttaagtttacggaacgtacgtaacgaaacgtacgtacgttaacgtacgtagaggaccgtacggtacgtactaacgtacgtacgtaccggaaaggggacgggaccaagggtcgaacgttacgacgttacgtcgtttacggaacgg

SEQ ID NO: 332822 - DNA, 790 bp, Homo sapiens
  misc_feature: GZ8MTXP02HT4Q3.8.34.D01.1.454.CMB.2.raw
  modified_base (296)..(296): a, c, t, g, unknown or other
  misc_feature (296)..(296): n is a, c, g, or t
  modified_base (406)..(406): a, c, t, g, unknown or other
  misc_feature (406)..(406): n is a, c, g, or t
  modified_base (570)..(570): a, c, t, g, unknown or other
  misc_feature (570)..(570): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgtaacttgggttttcctcgttgcttcttttaagaggtgtccagtgtcaagtgacaacgtggtggagtcgtgggggagcggtggtccaggccgtggggaggtcacgagagaccttgtcgtgtcgcacgcctcgtcggtccaccttanaacgttaacgtcggcatgcacgtcggtccgaccaagcctccgaggacgaagggtgttagggaggttggggtggtacgtaggttttcgtttacagttccgtgggaccggtnttaggttctttacgtaaagttggtagttcgacgtaaacggtccgttacgggacgggaaacggtacccgtattacccgaacctacttaccgtaccgaaaggacgtaaactaaacgttacccgaaaaggtaaaccctaataaacgtttagtttaaggttaacgggngttaaacgacgtaaacgaaccgtaaccttaacggttacccggtaggaaacccggggtaacgtaaccggggttacggtaaacgtttaaaccggttaaaccggttacggggtaaaacgggggaaaaccgggggtaaccggggggaaaaccgttaccgggggtaaaccggttaacccggttaaacgtaaaacccggtttacccgttttacggtttaacccggg

SEQ ID NO: 332823 - DNA, 585 bp, Homo sapiens
  misc_feature: GZ8MTXP02HFXXC.8.34.D01.1.454.CMB.2.raw
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtggggagtcacagagctcgtcgtgtcgcagcctgtggtcaccttcagtaacncggcatgcncgtggccncagcncgagcgaggntgggngtggngntgtnttcntngaggctggtntanagtggtatgacagactcgggagaggccattcaccgntcncagacgactaacgtcaacgaacactaagtgttagttacgacgttacagaaaccgcgtacgtaaacggttcgaggtaacggaccggtaaacggacgttaacgttacgtacggtaggggtaaaccgggaagggggaacgggggaacccaagggtaccgggtacgttaccggtaaacgttccgtttacgtacggtaaccgg

SEQ ID NO: 332824 - DNA, 631 bp, Homo sapiens
  misc_feature: GZ8MTXP02HOZOX.8.34.D01.1.454.CMB.2.raw
  modified_base (245)..(245): a, c, t, g, unknown or other
  misc_feature (245)..(245): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
  modified_base (408)..(408): a, c, t, g, unknown or other
  misc_feature (408)..(408): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccacctgtcttcgtctccaggggaaagagccacctctcctgcagggccagtcagaatgttggcnctacgtactctggtaccaacagaaaccnggcaggcctcccagcccctanactctatggtcgacataccaacgacggaccacgtggacacgtcccaagccgtaaggttccaaggtccggctagggtcgggtagtcgggactagtaccttcactctaccactacncaactcgagcccgttggagtccgtaggtacgagttagtgtcttaaagtttctaacttgttaacaattacgttcgaaccgttggccgggtcccgcgggggtacctaccggttaccggccggtaacggaaccgttaaaacggtgtaaacggttaacaaacgaaacggtaaccgttggtaaacgcgtaacggctaacctacggtcttacggtcctttaactcccgg

SEQ ID NO: 332825 - DNA, 754 bp, Homo sapiens
  misc_feature: GZ8MTXP02ISC81.8.34.D01.1.454.CMB.2.raw
  modified_base (261)..(261): a, c, t, g, unknown or other
  misc_feature (261)..(261): n is a, c, g, or t
  modified_base (331)..(331): a, c, t, g, unknown or other
  misc_feature (331)..(331): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagccgtgggaggtcacgagagactctcgtgtgcagcctntggttcaccttcagttaactacggcatcgccacgtcgggtcccaccaagcctaccgaggaccgaagggtnttgggagttggggtggctaggtttgtttcagttcgtaggacggggtctaaggttcgttacgaaagttgggtactggaccgtacgtaacccgttcccgggtaagggaaaccgggggtcccgtaacttacccgaaccctactaccgtacccgaagtaaacgtaacctaaacttaaccccgaaacggaaaacctaaccgtaaagttaggtttaagtttacggggaacgtacgttaagaaaacccgtacgtaaccccgttaaagtacccgtaggaacggaaccggtacggggtactttaaacgtaccttacggtaacggtaaaacgggaaacgggggtaacgggggaaccgtaagggtaccggggtaaccgttaaccgaaacggtttacccgttacggtttaccggtaccggttacggtaccggggg

SEQ ID NO: 332826 - DNA, 693 bp, Homo sapiens
  misc_feature: GZ8MTXP02FNCXS.8.34.D01.1.454.CMB.2.raw
  modified_base (284)..(284): a, c, t, g, unknown or other
  misc_feature (284)..(284): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggagtcacagagactctcgtgtgcagtcctcgtggttccaccttnaacgttaactaccggctagtcgacctaccgtgggtaccccgaccaaagccctacccggaaggtaccgtaaggggtattggggaagggttggggtcgcgttaaggttttcgtttacccgagttccgtaggggtacgggtacctaggttacgtttcgaaaggtgggttacgtcgaccgtaagtaccgttccggtagggaacggtccgtacttaccacgattccacgaagaacgactaaacttccgaaagaaaccactaaagtgttaacgttagggatacgtagaacacgtacgtaacgcgtaggaccgacgacgggtactacgtactaacggtacgtaaccggggaagggtaccgggggaaacgacggtaccgggtacgttaccgtaacggttacccgttcgtttaacggg

SEQ ID NO: 332827 - DNA, 611 bp, Homo sapiens
  misc_feature: GZ8MTXP02GBUTF.8.34.D01.1.454.CMB.2.raw
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggagcgtggtccagcctgggagtcacagagactctcgtgtgcagcctctggttcaccttnagtaactacggcatgcacgtgggtccnccaagctccgaggacaagggnttgggagtgggtgctagttgttcatctggaggtcagtgttacaagttgtntgcagcctcgngaacgggcctatcgaccatctaccgagtacgacaacttaccgaagaaacactaaattgtaagtttagggactacgtacgtaacaacgtaccgtaaacgtcccgtaggacggaacgacggggtacttaacgtaccgttacgtaggtaaaccggaaagggggacgggggaaacccgagggacggtaacggttacgaaacggttcgtaccgtttacggaccgttcgggtaccgggg

SEQ ID NO: 332828 - DNA, 681 bp, Homo sapiens
  misc_feature: GZ8MTXP02FGX4O.8.34.D01.1.454.CMB.2.raw
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtggtccagccgtgggaggtcacagagctctcgtgtgcagcctntgggtccaccttcagtaacgtacgcatcgcacgtcgggtccnccgaacgcctaccgaggacgaaggggtattgggaggtggggtggtctaggtttgtttcagttcgtggagggctagtgttactagtgggtaactggactacggactcgggtaggaacgggtcctacgttcaccgtataccgtacccgaagaacgtaaaccgtaacgttacccgaaacggaaaacctaaactaaacgttagggttaacgttttagggaaacggtctaaacgaaacgtaacgtaccgttaaacgtaccgtaggtaacggaccggaacggggtacctaagttaacgttacgtacgggtaaacggaacggggaacgggggacgaacgggtacggtacgtaccgacgttaacgtcccgttagtaccgg

SEQ ID NO: 332829 - DNA, 781 bp, Homo sapiens
  misc_feature: GZ8MTXP02FGPVL.8.34.D01.1.454.CMB.2.raw
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggtttcctcgttgctctttaagaggtgtccagtgtcaagtgcaactggtggagtcgtgggggagcgtggtccagcctgggagtcacagagactctcgtgtgcagcctntggttcaccttcagtaactacggcagtgcacgtgggtcccnccaaggctcccgaggtccgaaagggtattggggaggtggggtggctaggttttgttacccgattccgtaggaggggctaaggttgtttacaaagttgggttaatcggacctaaggtacccgttccggttagggaaacggggtacccggtacgtttaccgaaccctaacgttccctacccgaagtaacggaacctaaaaccgtttacccgaaacggggtaaaacccaaacctaaacgttacggttaacgttttagggggaaactcccgttaaggaaacctaacgggacccttaaaaggtccccgttaagggtaaaacggggaaaaccggggtacccggttaaattaaacccgtaacggttaacggtaaaccggggtaaaagggggtaacggggggaaaaccccggtaagggacccgggggtaaacgtttaccccggaaaacggtttacccgttaccccggtttaggtaaaccccggg

SEQ ID NO: 332830 - DNA, 639 bp, Homo sapiens
  misc_feature: GZ8MTXP02ITOGN.8.34.D01.1.454.CMB.2.raw
  modified_base (241)..(241): a, c, t, g, unknown or other
  misc_feature (241)..(241): n is a, c, g, or t
  modified_base (263)..(263): a, c, t, g, unknown or other
  misc_feature (263)..(263): n is a, c, g, or t
  modified_base (306)..(306): a, c, t, g, unknown or other
  misc_feature (306)..(306): n is a, c, g, or t
  modified_base (437)..(437): a, c, t, g, unknown or other
  misc_feature (437)..(437): n is a, c, g, or t
tcagctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtctgggggagcgtggtccagcctgggagtcangagactctcgtgtgcagtcctntgggttccaccttcagtaactacggcatgcaccgtgggtcccnccaaagcctaccgaggacgaaaggggatttggggaggtggggtggacgtaggttcgtttcactcgtaggagggctaggttgttacagttgggtaatgacgtagtacgtcggtagaagggccagttccactntcctaccgagacgaacaatccgaagaacactaaagtgttagttaggacgtacctagaaccgacgtaccgtaaagtttcccgagaacggtacgacgggaccgtttataaccgtacgtaggttaaccgggaaacggggtacgggggaacgtaagggaccggggttaactacccggtaagttaccctaccggtttacgaaccggg

SEQ ID NO: 332831 - DNA, 760 bp, Homo sapiens
  misc_feature: GZ8MTXP02ICDE6.8.34.D01.1.454.CMB.2.raw
  modified_base (324)..(324): a, c, t, g, unknown or other
  misc_feature (324)..(324): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagccgtgggaggtcacagagactctcgtgtgcagcctcgtggttccaccttcagtaactacggcatgcacgtcgggtcccaccaagcctccgaggacgaaggggntttaggggaggtttggggtggctaggtttcgtttcagttcgtaggaggggtctaggttgttacaagttgggtatgacacgtaccgtaccggtagggaaacgggtcccgactttaccgaacctacgtccgtaccgaaggtaacgtaaaccgtaacttaacccggaaaacgggtaaaccaaacgtaaaacgtttggtttaaacggtttacgggtaacgtacgttaacggaaaccgtaaccggtaacccgttaaaacggttcccgtagggaacgggaaccgtacggggtaccgtttaaacgtaaccgtttacggtaacggttaaaccgggggaaacggggtaaaccggggggaaccgtaacgggaccgggggtaaacgttaccgtaaaacggtttaccgtacccgtttacgggtaacccggtttacgggtacccggggg

SEQ ID NO: 332832 - DNA, 688 bp, Homo sapiens
  misc_feature: GZ8MTXP02IK5TE.8.34.D01.1.454.CMB.2.raw
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttggctgaactgggttttcctcgttgctcttttaagaggtgtccagtgtcaagtgcaactggtggagtcgtgggggagcgtggtccagcctgggagtcacagagactctcgtgtgcagccttctgggttccaccttcagtaactacggcatgcacgtggtccnccaagcctaccgaggcaagggtnttgggagtgggtgctagttgtttacatcgngagggctaggttgttcgaagttggtactgaccagtaccttcccggtaggaacgggcccgtattaccacctaacgtcctaccgaagacgaacctaaacgttaccgaaaggaaacctacgtaaagtttagttaagtttagggaactacgtaacgaaacgtacgtaacccgttaaacgtcccgtaagggaaacggtaccggtaacggggtacgttaaacttaaaccggtaacgttacgggtaaaacgggaaagggggaaccgggggtaaaaccgcggggaaccggggttaacgttaacccgtaacggtttaccgttacccggttttaacggg

SEQ ID NO: 332833 - DNA, 737 bp, Homo sapiens
  misc_feature: GZ8MTXP02JYGHE.8.34.D01.1.454.CMB.2.raw
  modified_base (172)..(172): a, c, t, g, unknown or other
  misc_feature (172)..(172): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagnggtgtccagtgtcaagtgcaactggtggagtcgtgggggagcgtggtccagcctgggagtcacagagactctcgtgtgcagcctcgtggttcaccttcagtaactacggcatgcacgtcgggtccacaagcctccgaggccgaaaggggnttggggagtggggtggctaggtttgtttcagttcgtgggacgggtctaggttgtttacaagttgggtatcggacaggtaccgtccggtaggaaacggggtcccgtaagttccaacctacgttcctacccgaagtacgtaactaaacgttaccgaaacggaaacctaacgtaaagttacgtttaagtttacgggacgtacgttaacggaaaccgtaaccgtaacccgttaaaacggttcccgtaagggaaccgggaacgtaccgggggtaacttaacgtaaaccgttaaacggtacggggtaaaacgggtaaacgggggaacggggggaaaccgaacggggaccgggggtaacgttaacccggtaaacggttacccgttacccggtttacggtaacccggttccggtacccggggg

SEQ ID NO: 332834 - DNA, 744 bp, Homo sapiens
  misc_feature: GZ8MTXP02FPHXD.8.34.D01.1.454.CMB.2.raw
  modified_base (174)..(174): a, c, t, g, unknown or other
  misc_feature (174)..(174): n is a, c, g, or t
  modified_base (278)..(278): a, c, t, g, unknown or other
  misc_feature (278)..(278): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgacaacgtggtggagtcggtgggggagcgtggtccaggccgtgggagtcacagagctcgtcgtgtgcagtcctcgtggtccaccttnacgtaactacggcagtcgactacgtcgggtcccaccgaagcctaccgaggacgaagggtgtggggaggtggggtgtcgtaggtttcgtttacacgttcgaggacggggtcttaggttccgttagtaggttcgggtaagttcggaccgtaacggttaccgtaccggggtaagggtaaaccgggggtccctaaacgtttacccgaacccttacgtcccgtaccgaaggaacgtaacctaaacgttaccgaaacggaaacctaaactaacgtttacggttaagtttagggacgtacgttaacggaacgtacgtacccgttaaacgtcccgtaagggaacggaccggtaacgggtacgttaaacgtacgttaaacggtacgggtaaacggggtaaacgggggacgggggaaacgcgggtacggggtaacgtaccggtaaacttaccggttaccggtttacggtacccggg

SEQ ID NO: 332835 - DNA, 631 bp, Homo sapiens
  misc_feature: GZ8MTXP02G6YSY.8.34.D01.1.454.CMB.2.raw
  modified_base (275)..(275): a, c, t, g, unknown or other
  misc_feature (275)..(275): n is a, c, g, or t
  modified_base (327)..(327): a, c, t, g, unknown or other
  misc_feature (327)..(327): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
  modified_base (493)..(493): a, c, t, g, unknown or other
  misc_feature (493)..(493): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgtcgcagtcctcgtggtcaccttnaagtactcggcagtgccacgtcgggtccaccaagcctcgaggcgaaagggtnttggggaggtgggtgtctagttgttcatcgtaggaggctagttntacagttgagtcgnagtacgtcggaggtaacgccgtatacacgtntacgtcgaagactaactaacgtaccgagtaaacagtaaatgttagttagactacgaactaacgtacgtaacgttacnccgggtaagacggtacggtaaccggtactaaacgtaccgttacgggaaacgggtacggggaaaacgggggtaaccgggaacgtaacggggtcgtaaccgttaacggaacgtttaccgttacggttacggtacccgggg

SEQ ID NO: 332836 - DNA, 785 bp, Homo sapiens
  misc_feature: GZ8MTXP02HL13Z.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtggtccagccgtgggagtcacgagagactctcgtgtgcagcctgtggttcaccttcgagtaactcggcatgccgtacgtcgggtaccccaccgaacggcctacccgaggccgtaaaaggggtatttggggagggttggggttcggaccttagggttttcgtttaccgagtttccggtagggaacggggtctaagggtttcgttaacgtaaggtttcgggtagtttcgggactaaaggtaccttacccggggtagggaaccgggtacccgtacgtttacccaaccgtcttacctaccgaacggtaacgtaaccttaacgtacccgaaacggaaacctaaaccgtaaaaggtttccggttaaagtttagggtaacgttacgttaacgggtaaactaccggtacccgtaaagttccgaagtacggtacgtacgggtacgttaacgtaccgttaacggtacggtaaacggggaaacggggtacgggggaaacacggggtaccgggtaaacggttacccgtaaaacgttaccggtttaccgttaacgggtaccggttacgggttaacccggggg

SEQ ID NO: 332837 - DNA, 635 bp, Homo sapiens
  misc_feature: GZ8MTXP02GKIB8.8.34.D01.1.454.CMB.2.raw
  modified_base (173)..(173): a, c, t, g, unknown or other
  misc_feature (173)..(173): n is a, c, g, or t
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgcttcttttaagnggtgtccagtgtcaagtgcaacgtggtggagtcgtgggggagtcgtggtccaggccgtggggaggtcacgagatacctctcggtgtgcaggtcctgtggtccaccttnagtaactacggcatggcacgtgggccaccaaggcctccgaggacgaaggggtnttgggagtgggtcgctagttgttcagtcgtgggacggtctagttacgtactagtcgtatgcgagtcgtcggtgaacgggtctatcacgatccacagtaacactataccaaagactacgtaagttgtacgttgggactactagaaactacgtacgtaaacgtccgagaacggaccggtaacggtccttaagtaaacccgtaaaggtcggtaaaacggggaaacgggggtaaccgggggaaacgaacgggggtaaccggtaacgttaaccgaaacggtttccttacgggttacggtaaccggg

SEQ ID NO: 332838 - DNA, 647 bp, Homo sapiens
  misc_feature: GZ8MTXP02I79GD.8.34.D01.1.454.CMB.2.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcgagggccagtcagatgtgcncctagtatcctgtaccaanacgaaacctggccaggcctcccacggccccctanactctagtggtcgcactccaacgacgggcccacgtcggaccactcccgagccgtaggttcaggtcgcgaggtgggtagtgggacagtacttcgactcctacacctatccatacacgccctagggacgtccgtaggaaggtgttgttacgtacgttaagtttacttaccgtagttacctaaactacgttacggtaccgtagtccgggcccggttacccgggggtcccttaccggtttcccgggacccgtaacggggtaaccctaaaagggttcggaacgttaacgtaaacgaaaacggttacgtacggtcggtatccggtactaccgtacttcggttctcctttactcc

SEQ ID NO: 332839 - DNA, 821 bp, Homo sapiens
  misc_feature: GZ8MTXP02HZVL8.8.34.D01.1.454.CMB.2.raw
tcagctcgcgtgtccacgaccggtgctcgatttagatcgtctgtgttgggtctgggagaggagcccagcactagaagtcggcggtgtttccattcggtgatcagcactgaacacagaggactcaccatggagtttggctgaactgggttttcctcgttgctcttttaagaggtgtccagtgtcaagtgcaacgtggtggagtcgtggggggagtcgtggtccagccgtggggagtcacagacgactcgtcgtgtgcagtcctcgtgggttcaccttcagttaactcggctagtcgccacgtcgggtccccgacgaacgcctacccgaggggccgaaaagggggtctttgggggaggttcggggttaggtccgttaagggttttcggttttaccaagtttccggtaggggtaacggggtccttaggtttacggttacgaaagtttcggggtattcgggacccgtaggtaacccgttcccggggtagggtaaacgggggtcccccttaagttaccaacccgtattacccgtacccgaaaggtacgtaaccgtaaacgttacccgaaacggtaaaccaacgttaaaggttacgtttaaacggtttaggtaacgtaccgttaacgtaaccggtaacctaccgttaaacgttcccgtaagggaacggtaccggtaaacgggtaccggttaaacgtaccgttaaccggtagggtaaaccggggaaagggggtaaccgggggaaaaccgtaggggtaaccgggtaacggttaacccgtaacgtttacccggttaccgtttaacggtcccggttaacggtccccggggg

SEQ ID NO: 332840 - DNA, 697 bp, Homo sapiens
  misc_feature: GZ8MTXP02JUSDT.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtgggtggaggtcggtggggggaggcggtggtccaggccgtggggaggtcacagagctctcgtgtgcacgcctcgtggttcaccttcaagtaactacggcatcgctacgtcgggtcccaccgaacgtcctaccgaggacgtaaaggggtagtttaggggagggttggggtcggtcttaggtttcgtttacagtcgtgggagggtctaggttgttacaggtgtagtcgacgacgtaccgtcgggtagggaacggggtcctaattcccacctatccgtacacggaacaactaacctacgaaacggaaaccataagttagttagttagggagtactacgaaccgacgtaaccgtaacgtcccgaggaacgaaccggtacgggtacgttacgtaaccgttaacggtacgggaaacggggtaaacgggggaacgggggtaaaccgaaggggtaccggggtaaacgtaccggtaacgtttaccgtttaccgttacggtaacccgggg

SEQ ID NO: 332841 - DNA, 649 bp, Homo sapiens
  misc_feature: GZ8MTXP02IG8P0.8.34.D01.1.454.CMB.2.raw
  modified_base (298)..(298): a, c, t, g, unknown or other
  misc_feature (298)..(298): n is a, c, g, or t
  modified_base (407)..(407): a, c, t, g, unknown or other
  misc_feature (407)..(407): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggaggtcgtgggggagcgtggtccagccgtgggagtcacagagactctcgtgtgctagccttcgttagggttctaccttgaacgtaacctacggctaancgaccacgttcgggaccccacgaagcctcgaggacgaaggtagttgggaggtcgggtggacctaggtttgttacgagtcgtggacggtcaagttgtactaagttgtagngactacgacctcggtagaggtcactcactactcacagacactactacaagaacactagttcgttaagtgggtacactaggaactacgtaaccgtagtaccgaggaaccgtacggacgggtaccttattaacgtacgttaggaaacgggtaacgggggacggtaaaccggacggtaacggtaaccgtttaacccgtaaagttcccgtttaccgttacggtaccggtttacgggtacccggggg

SEQ ID NO: 332842 - DNA, 564 bp, Homo sapiens
  misc_feature: GZ8MTXP02FZQJ2.8.34.D01.1.454.CMB.2.raw
  modified_base (299)..(299): a, c, t, g, unknown or other
  misc_feature (299)..(299): n is a, c, g, or t
  modified_base (454)..(454): a, c, t, g, unknown or other
  misc_feature (454)..(454): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtgggagtcgtgggggagcgtggtccagccgtgggagtcacagagactctcgtgtgcagcctcgtgggttcaccttcagtaactacggcatgcactgggtccnccaagctccaggcaagggattgggagtggggtggctaggttgtttcatcgtggaggggcagttgttacagtggtatgcagactcggagaaggggccgtatccaactatcctaccagaacgactaatacccgagaaacactaatagtagttagagntagaacgagacctaagcctagagaacgtacggactatacgtagtacgtacggaaacgggacggggaacgaagggacggtacgtaccgacgttaacgtccgttagtaccgg

SEQ ID NO: 332843 - DNA, 717 bp, Homo sapiens
  misc_feature: GZ8MTXP02GHH0P.8.34.D01.1.454.CMB.2.raw
  modified_base (305)..(305): a, c, t, g, unknown or other
  misc_feature (305)..(305): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagccgtggggaggtcacgagagactctcgtgtgcagcctcgtgggtccaccttcagtaactacggcatcgcacgtcgggtccnccgaaaggcctaccgaggacgaaaggggtattgggaggtggggtcggtcgtaggtttgtttcaagttcgtggacgggctggttagttacagttggtaatggactacgtacgtccgggtagaaacggggtcctaacgttacaaccgtatccctacgaacggtaacaacgtaaactacccgaaaggaaaccctaagtaaagttagtttaaggtttaggacgtacgtaacgaaacgtaacggtaccttaaacggtcccgtaaggaacggggaaccgtaaccggggtaaccgttaaagttaacccgttaaaggtaacgggttaaaaccgggaaacgggggaaaccgggggaaacgtaacggggacggggttaaaccgttacgtaaaccggtttaacttcccgtttaggtaacccgg

SEQ ID NO: 332844 - DNA, 646 bp, Homo sapiens
  misc_feature: GZ8MTXP02H25V7.8.34.D01.1.454.CMB.2.raw
  modified_base (273)..(273): a, c, t, g, unknown or other
  misc_feature (273)..(273): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagccgtgggaggtcacgagagactctcgtgtgcagcctcgtggttcaccttnaagtaactacggctagtgcctacgtcgggtcccgaccaacgcctccgaggtaccgaaaggggagtttcgggaggttggggtcggcgtaggtttcgtttcagtccgtggagggctaggtgttacaagttgtagtgactacgtacgtccgtagggaaacgggccgtacttccgaacctatccctacgaagaacgtaactaaacttccgaaagtaactaacgtaagtttgttagttaggagactaggaaacctagaccgttaagtccgtaggacggtacgacgggtactaacgtacgtacgacgtaacgggaacgggtacgggacaggacggtaacgttcgaacgttacttccgttacggtaccgtacggtccggg

SEQ ID NO: 332845 - DNA, 615 bp, Homo sapiens
  misc_feature: GZ8MTXP02J1819.8.34.D01.1.454.CMB.2.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
tcagctcgcgtgtccacgaccggtgctcgatttagatcgtctgtgttggggtttggggaggaactgctcagttaggacccagagggaaccatggaagccccagctcagcttctcttcctcctgctactctggctcccagtttcagataccaccggagagattgtgttgacacaatctccagcccaccctgtcttcgtctccgaaggggaaanacgcccaccctctcctgccagggccagtcagattgtggcncctagtatcctaggaccaanagaacctggccaggcncccagcccctnatctagtgtncatcccgaaagcggggcctagtcggacacgtaccccagacctagggtcaaggtcggacctagggtggggtaatgggactagtacctcaccttcacacccnttcanctagccctgggacnctagaggtatggttnacgttatttacttacgtntacaaacgtcgttaccgaccgggtaggtcccggtccccggggtaccggggaccttaccggttcccggggaacgtacggggaaacctaaagggtgaacctaaggtaaccaaacggtcgtaggtcggactgaccacctattcgtctacctgtcccg

SEQ ID NO: 332846 - DNA, 701 bp, Homo sapiens
  misc_feature: GZ8MTXP02GK3SB.8.34.D01.1.454.CMB.2.raw
  modified_base (241)..(241): a, c, t, g, unknown or other
  misc_feature (241)..(241): n is a, c, g, or t
  modified_base (322)..(322): a, c, t, g, unknown or other
  misc_feature (322)..(322): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaacttgggttttcctcgttgcttcttttaagaggttgtccagtgtcaagtgcaactggtggagtcgtgggggagcgtggtccagcctgggagtcacgagngacttctcgtgtgcagtcctgtgggttccacttcagtaactcggcatgcacgtgggtcccacaagctaccgaggacaaggnttggaggtgggtgtctagtttgttcgagttcgtgggaggtctaggttgttacgaagttcgggtatcgtacaggtaccgtccgggtaggaaaccgggtccgaactttaccaaccgtatccgtacgaacgacgaactaacttaacccgaagaaacctaactaaagtagttagtttaggacgtcgttagaaccgtacgtaacccgtaaacgtccgtaacggtaggaccgtaaccggggtacgttaacgtaaaccgttaaccggttacggtaaacggggtaaacgggggacgggggtaaaaccgaccggggtacgggtaaacggttacccgtaaagggtttacccttaacggtttaccggtaccggtttacgggtcccggggg

SEQ ID NO: 332847 - DNA, 738 bp, Homo sapiens
  misc_feature: GZ8MTXP02HZJDB.8.34.D01.1.454.CMB.2.raw
  modified_base (273)..(273): a, c, t, g, unknown or other
  misc_feature (273)..(273): n is a, c, g, or t
  modified_base (326)..(326): a, c, t, g, unknown or other
  misc_feature (326)..(326): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcacatggagtttgggctgaacttgggttttcctcgttgcttcttttaagaggtgtccagtgtcaagtgcaacgtggtggagtcgtgggggagcgtggtccagccgtgggagtcacagagactctcgtgtgcagcctcgtggttccaccttnagtaactcggcatgcacgtgggtcccacaacgcctaccgaggcgaaaggggtntgggagtggggtgctagttcgtttcagtcgtggaggtctagttgttacaagttggtatgacaacggtaccgtccgggtaagggaaccgggtccctaacgttaccaacctacgttccaccgaagaacgtaacctaacttaacccgaaaggaactaaacgtaaagttaggttaacgtttagggaagtacgtaacggaaacctaacggtaccgttaaacggtcccggtaagggaaccgggtaacggtaaccggggtacgttaaacgttaacggttaacggtaacggggttaaaacggggaaacgggggtaaaccgggggaaaccgaagggggtacccggggttaaaccgttaaccggttaaacggttacccgtttaccggtttaccgggtaaccgggttccgggtaacccggggg

SEQ ID NO: 332848 - DNA, 693 bp, Homo sapiens
  misc_feature: GZ8MTXP02HKZ35.8.34.D01.1.454.CMB.2.raw
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (645)..(645): a, c, t, g, unknown or other
  misc_feature (645)..(645): n is a, c, g, or t
tcagctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtggtccagccgtgggaggtcacagagactctcgtgtgcngcctcgtggtccaccttcagtaactcggcatgccacgtcggtcccaccaagcctacgaggacgaagggtnttgggaggtgggtgtactaggtttcgttaccagtcgtaggacgggtctaggttcgttacgagttggtatcgacgtaacgtaccgtcggtaggaacgggtcctagtccactatcctaccgaaggtactaaactaacgttaccgaaacggtaaacctaaacgtaagtttaggttaagtttaagggactaaccgtaacggaaacgaccgtaaccgtaaacgtccggtaaggaaccgggtaaccgtacggggttaccttaaactaacggttaacggtacgggaaacgggaacgggggaaccgggggtaaaccgngggtaaccgggttaccgtaaccgtacgttaccgtttaccggttacggg

SEQ ID NO: 332849 - DNA, 832 bp, Homo sapiens
  misc_feature: GZ8MTXP02GLZN6.8.34.D01.1.454.CMB.2.raw
tcagctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccgaggggaaagacgccaccctctcctgcacgggccagtcaaggatggttggccgacctacgtatccgtggtaacccaacgaacgaaaccgtcggacccacggcctaccccgacggtccccctacacttctagtggtcacactacccgaaacgccggggcctacggtcggaccaaccgtcccgacgccgtacggttcaggtcggacgtaggggttaggggtagtcggggaactacggtaccttaccgaccttcctaccctaaccgtaacttcctaactaccgaacggtcccggttacgggaccggcccgttagggaacgggttcgtttaaggttcgttaacggtttacgttttaacgttacgttaccgttaaaccgtaacgttacggttacccgggttaaccgggtcgggtcccgggtacccgggttccccgggggttacccttaacccggggtttccccgggacccgggtttaacggggaaaaccccggtaaaaggggttaccgtaaacgtttaaacccggtaaaaccggtaaaaccggttaacggttacgggttaaccggttaccgaaccgggttaacccctaaacgtttccgttacccgtttacggtttccctttaaacccggtttcccccg

SEQ ID NO: 332850 - DNA, 717 bp, Homo sapiens
  misc_feature: GZ8MTXP02FKTNS.8.34.D01.1.454.CMB.2.raw
  modified_base (366)..(366): a, c, t, g, unknown or other
  misc_feature (366)..(366): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggaggcgtggtccagcctgggaggtcacagagactctcgtgtgcagccctgtggttcaccttcagtaactacggcatgcacgtgggtccaccaagcctccgaggacgaaggggtagttagggaggtggggtcggtactaggtttgtttcagttcgnggagggctaggttgttacagtggtactagcagtaccgtaccggtaggaacggggtcctacgttaccaacctacgttacccgacccgaagaacgaaaccttaaacgttaccccgaaaggaaaacctaaacgtaaagttaggtttaagtttacgggaagtacgttaacgtaaaacgacggtacccgtaaacgttacccggaggaaacgggaaccggtaacggggtacgttaaacgtaaaccgttaacggttacgggaaacggggaaaacgggggaacgggggtaaacccgaagggggttacggggaaccggttacgtaaaaccggttacctttcccggttaagtacccggggg

SEQ ID NO: 332851 - DNA, 660 bp, Homo sapiens
  misc_feature: GZ8MTXP02GQI6J.8.34.D01.1.454.CMB.2.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgctctttaagaggtgtccagtgtcaagtgcaactggtggagtcgtgggggagcgtggtccagccgtgggagtcacagagactctcgtgtgcagcctcgtggttcaccttnagtactacggcatgcacgtgggcccncaagcctacgaggacgaaggggntttgggacggtggggtggctaggttgtttcacgtcgtggaggctagtgttacagtgtatgcagtctacggtagaacgggctactacaccgatcctaccgaagacgtaacctacttaccgaaaggaaacctactaaattgtttaagtttgggaactcgtaacgaacgtacgtaccgtaaacgtccgtaggaaacggtacccgacggggttactaaacgttaccgttaaacgggaacggttaaaccggggaaaacggggggtaaccgggggaaacccgtaagggggaaccgggtacgttaaacccgacggtttaccgtttaccccggtttaggtaaccgggg

SEQ ID NO: 332852 - DNA, 628 bp, Homo sapiens
  misc_feature: GZ8MTXP02JFIRJ.8.34.D01.1.454.CMB.2.raw
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
tcagctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggagtcacagagactctcgtgtgcagcctcgtgggtcaccttnagtaactacggcatcgcacgtcggggtccnccaaagcctacccgaggcgaaaggggattgggaggtggggtggctagtttgtttcagttcccgtaggacggggtcaggttggttacaagttgggtatgacagaccttcggagaacgggccgattcaccgtactcctacagacgactaacttaccaaggtaaacaacgaattaggtactttacggagtacgtacgaacacgtaccttaacgtccgtaggaacggacgacgggtacgtaagtaccgtacgtacggtaacggaacggggtaacggggaaccgaggaacgggtacgttaccgtaacgtacgtaccgtttacggacgttacgg

SEQ ID NO: 332853 - DNA, 612 bp, Homo sapiens
  misc_feature: GZ8MTXP02I2QVZ.8.34.D01.1.454.CMB.2.raw
  modified_base (302)..(302): a, c, t, g, unknown or other
  misc_feature (302)..(302): n is a, c, g, or t
  modified_base (326)..(326): a, c, t, g, unknown or other
  misc_feature (326)..(326): n is a, c, g, or t
  modified_base (471)..(471): a, c, t, g, unknown or other
  misc_feature (471)..(471): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtggtccagccgtgggaggtcacagagacttctcgtgtgcagccttctgggttcacgttcagtaactcggcagtgccacgtgggtcccnccaaaggcctccaggcgaaagggntttagggaggtgggtagcctaggtttgttcagtcgtgacggggctaagtcggttacagtgggtatgactagactcggtagaacgggccgattcaccattcacagaagctaaatccaagtaaacactaaatcggtttaattggganaccgtagaaccagtacctaaagtccgtaggacgaccgacgggtaccgtattaccgtaacgtacggttaacggaaacgggagggggaaacccaagggacgggtacggttaccgaaaggttaccttaccgtttaggtaaccgg

SEQ ID NO: 332854 - DNA, 655 bp, Homo sapiens
  misc_feature: GZ8MTXP02H6N5B.8.34.D01.1.454.CMB.2.raw
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
  modified_base (598)..(598): a, c, t, g, unknown or other
  misc_feature (598)..(598): n is a, c, g, or t
tcagctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaagtggtggagtcgtgggggagcgtggtccagccgtgggagtcaacgagagactctcggtgtgcagtcctcgtggtccaccttcagtaactacggcatgcacgtcgggtcccgaccaaagcctccgaggcgaagggtattgggaggtggggtgcgtagtttgtttacagtcgtggagggtctagtgttcaagttggtntgacagtacgttccgnggaacggcctacttaccaccgtactcgtaccgagacgtaactaacttaccgaaggtaactaaacgtaagttaggttagttaggtagaccgtagaaacgtacgtaacctaaagtccgtaggaacggaacgtacggggtacttaacgtaaccgttacgtacggtaaaccgggaaacgggggaacgggggaaccgngggaacgggtaacgtaccgaaacgttcctaccgtttacgacggttacggtaccgggg

SEQ ID NO: 332855 - DNA, 741 bp, Homo sapiens
  misc_feature: GZ8MTXP02IVAA4.8.34.D01.1.454.CMB.2.raw
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtggtccagccgtgggagtcacagagactctcgtgtgcacgtcctcgttcggtcctaccttagacgtaacgtacgctagtgcctacgtcgggtccacaagcctacgaggacgaagggtcgttagggtaggtggggtacggtcgttaggtttcgttctacgtcgtagggacggtacgttaggttacgttactagggggttacgttagtacggaccgtaacgggtaccggtaccggggtaagggaaaccggggtcccttaacgttacccaaccgttacttacccgtacgaacggaacgtaactaacgtaccgaaaggaaaccctaagttaagtacgtttcgttaggacgtacgtacgaaccgtacgtaccgtaaacggtccgtagggaaggtaacccggtaacggtactaaacgttaccgttaacggtacgggtaaaacggggaacgggggtaaccggggaaaccgaacggggtacgggtaaccgttaccggtaaccgtttacgttaccggttagggtaccccggg

SEQ ID NO: 332856 - DNA, 728 bp, Homo sapiens
  misc_feature: GZ8MTXP02G4VZU.8.34.D01.1.454.CMB.2.raw
  modified_base (331)..(331): a, c, t, g, unknown or other
  misc_feature (331)..(331): n is a, c, g, or t
tcagctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtggtccagcctgggagtcacagacgactcgtcgtgtgcagcctcgtggtcaccttcgagtaacctacggcatcgacacgtcgggtcccacgaagcctaccgaggacgaaagggtntttgggaggtggggtcgacgtaggtttcgtttcatccgtaggagggtcctaaggttcgttacgagtggtatgacgagtaccgtccgtaggaaccgggctagtccactataccgcctaagacgtaactaacgttaccgaacggaaacctaacgtaaagttacggtttaagtttacgggaacgtacgttaaacgaaaccgtacggtaacccgttaaacggtaccccgtagggaaacggtaaccggtaaccggggtaacgttaaaccgttaaaccgtaaccggtaaaggtaaccggggaaaacgggggtaacccggggggtaaacccgtaaggggaacccggggttaacgttacccggtaaaacggtttcccggtttaacgtttaacggtaaccccgggg

SEQ ID NO: 332857 - DNA, 645 bp, Homo sapiens
  misc_feature: GZ8MTXP02IK7OU.8.34.D01.1.454.CMB.2.raw
  modified_base (189)..(189): a, c, t, g, unknown or other
  misc_feature (189)..(189): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
tcagctcgcgtgtccacgaccggtgctcgatttagatcgtctgtgttgggtttgggggagctctgggagaggagcccagcactagaagtcggcggtgtttccattcggtgatcagccactgaacacagaggactcaccatggagtttgggctgaacttgggttttcctcgttgcttcttttaagaggtntccagtgtcaagtgcaactggtggagtcgtgggggagcggtggtccagccgtgggagtcacagtanactctcggtntgcgagtcctcgtggttaccncctttagagttaaccgcggacagtcgacctacgttggggcccaccaagccgtaccgaaggccgaaaggggattcgggaagtcggggtagtctagtttgttccagtcgtggaggctagttcgtagtatggtaangnagactacggagacggactactacactatacccatacgacaactaaactaccgaaagacaatagttattaggttcgggaatacgtaacaacgtaaccgtaaccgtaacgtacgtacgacggtaacggaacggtacgtaaacgtaacgtacgtaaggaaccggaaacggggaacggggaaccggtaacggaacggtaccgtaacgtaacgttaacgttaccgtacg

SEQ ID NO: 332858 - DNA, 734 bp, Homo sapiens
  misc_feature: GZ8MTXP02GAR7M.8.34.D01.1.454.CMB.2.raw
  modified_base (272)..(272): a, c, t, g, unknown or other
  misc_feature (272)..(272): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (464)..(464): a, c, t, g, unknown or other
  misc_feature (464)..(464): n is a, c, g, or t
tcagctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctcagccaccctgtcttcgtctccagggggaaagacgccaaccctctcctgcagggccagtcagaatgttaggcgcctacgtatcctggaacccaanagaaacctggccaggctacccaggccccctanatctagtggtanacactaccgaaacgacggaccacgtcggactacgtacccacggtaccgtaaggttacgaggtcggacgtagggtaggggttagtacggggaactacgtaccttcactacctaccgaacctaagtactaaacgtcacgtcgtagggacncggtagagtagtgttacgacgtttaaagtttaacgttaacgttacgtaaactaaaccgtacgtttacccggttaaacccggaagggttacccgggtaccccgggttaccccgggggtaacccgtttaacccgggttcccgggtaaccccggttaacggggaaaacccgttaaaacgggtacgtaaaacgtaacgtaaaccggaaaacgtaacgtcggtacgtaccgtaacgacctaaccgtacgttacctacggttccgtttactaaccg

SEQ ID NO: 332859 - DNA, 431 bp, Homo sapiens
  misc_feature: GZ8MTXP01AOMOW.15.77.G11.1.454.CMB.2.raw
  modified_base (291)..(291): a, c, t, g, unknown or other
  misc_feature (291)..(291): n is a, c, g, or t
  modified_base (426)..(431): a, c, t, g, unknown or other
  misc_feature (426)..(431): n is a, c, g, or t
tcagtctacgtagccacgaccggtgctcgatttagctagtcactcaagggaaagggactggagtggataggctatatccgcttcactgggagcaccaactacaacccctccctcaagagtcgactcaccatatctttagacacggccaacaaccagttctccctgaggctcagctctgtgaccgccgcagacacggccgtctattactgcgcgagacggagggtagacggtgaccggggctcgtttgactacgtgggggccagggaatcctggtcaccgtctcctcggccnccaccaagggcccatcggtcttccccctggcaccctcctccaagagcacctcgtgggggcacagcggccctgggctgcccctggtcaaggactacttccgctcgtagactggagcgggctgggcaggcgcatagnnnnnn

SEQ ID NO: 332860 - DNA, 424 bp, Homo sapiens
  misc_feature: GZ8MTXP02FVTZZ.15.77.G11.1.454.CMB.2.raw
  modified_base (422)..(424): a, c, t, g, unknown or other
  misc_feature (422)..(424): n is a, c, g, or t
tcagtctacgtagccacgaccggtgctcgatttagctagtcactcaagggaaagggactggagtggataggctatatccgcttcactgggagcaccaactacaacccctccctcaagagtcgactcaccatatctttagacacggccaacaaccagttctccctgaggctcagctctgtgaccgccgcagacacggccgtctattactgcgcgagacggagggtagacggtgaccggggctcgtttgactactggggccagggaatcctggtcaccgtctcctcggcctccaccaagggcccatcggtcttccccctggcaccctcctccaagagcacctctggggcacagcggccctggggctgcccctggtcaaggactacttccgctcgtagactgagcgggctggcaaggcgcatagnnn

SEQ ID NO: 332861 - DNA, 430 bp, Homo sapiens
  misc_feature: GZ8MTXP02JYKTQ.15.77.G11.1.454.CMB.2.raw
  modified_base (423)..(430): a, c, t, g, unknown or other
  misc_feature (423)..(430): n is a, c, g, or t
tcagtctacgtagccacgaccggtgctcgatttagctagtcactcaagggaaagggactggagtggataggctatatccgcttcactgggagcaccaactacaacccctccctcaagagtcgactcaccatatctttagacacggccaacaaccagttctccctgaggctcagctctgtgaccgccgcagacacggccgtctattactgcgcgagacggagggtagacggtgaccggggctcgtttgactactggggccagggaatcctggtcaccgtctcctcggcctccaccaagggcccatcggtcttccccctggcacccctcctccaagagcacctctgggggcacagcggccctgggctgcccctggtcaaggactacttccgctcgtagactgagcgggctgggcaggcgcatagnnnnnnnn

SEQ ID NO: 332862 - DNA, 504 bp, Homo sapiens
  misc_feature: GZ8MTXP01DHHPV.3.75.G09.1.454.CMB.2.raw
  modified_base (252)..(252): a, c, t, g, unknown or other
  misc_feature (252)..(252): n is a, c, g, or t
  modified_base (450)..(450): a, c, t, g, unknown or other
  misc_feature (450)..(450): n is a, c, g, or t
  modified_base (472)..(472): a, c, t, g, unknown or other
  misc_feature (472)..(472): n is a, c, g, or t
tcagagacgcactccacgaccggtgctcgatttagtatagacatcaggggacactgagtgtgagtgaacatgagtgagcaaaactggatttgtgtgccattttctgataacggtgtccttctgtttgcaggtgtccagtgtcaggtgcagctggtgcaggtcgggggagcgtggtccagcctgggaggtccctgagactctcctgtgcagcctctggcttcatcttcagtagctataaaatgcactggtccncaggctccaggcaaggggctggagtggtggcacttatttcatatgatggaagacagatacttcgcacgactcgtgaaggccaagtcaaccatctaccagagacaaattccaaagaacacggtgtctctgacaagtgaaatagcctagagacgtgggacgaacacgggctgtgtattacgtgtgcgagagagggtttcncagcttcgtccgggcggcccgngttcgaacatgaactattcaacttcgtaacgg

SEQ ID NO: 332863 - DNA, 694 bp, Homo sapiens
  misc_feature: GZ8MTXP01BHXDH.3.75.G09.1.454.CMB.2.raw
  modified_base (217)..(217): a, c, t, g, unknown or other
  misc_feature (217)..(217): n is a, c, g, or t
  modified_base (262)..(262): a, c, t, g, unknown or other
  misc_feature (262)..(262): n is a, c, g, or t
  modified_base (583)..(583): a, c, t, g, unknown or other
  misc_feature (583)..(583): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagccgtgggaggtccctgagactctcctgtgcagcctntggtcttcattcttacagtagactaataaatgcacgtcgggtccncaggctccgaggacgaaggggctgggagtgggtggctacgtttattcatagtgagtagggaaagaacagtactacgttcgacacgaccgtcggaggaacgggcccgaaagtaccaacctactcctacccgaagaacgaactaaacgttaacccgaaaggtaaccgtaacgggtcgtaccttacgtacgaaccgtaaaggtagaaacttacggaccgtaggaaacgtaccggtacggggaaccgtaacggaccggtacgtttaggtagttaacgtttacggtaggtacgggaccggtaagggtagggttacgggggtttccncggttaacgggttcccgttccgggggtaccccggggccgggttaccccgttaggttacgaaacctagttcgtaacgttacttaccgtaaccgtttaaccgggttaaccggg

SEQ ID NO: 332864 - DNA, 595 bp, Homo sapiens
  misc_feature: GZ8MTXP01EGCEO.3.75.G09.1.454.CMB.2.raw
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (362)..(362): a, c, t, g, unknown or other
  misc_feature (362)..(362): n is a, c, g, or t
  modified_base (441)..(441): a, c, t, g, unknown or other
  misc_feature (441)..(441): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagcctgggaggtccctgagactctcctgtgcagcctctgacttcatcttcagtagctaataaaatgcactggtccncaggctccaggcaagggggctggagtgggnggctactttagtttcattatgatgggaaaggaacagatacttcgacacgactcgtgaacggccgaaagtcaacatcnccagagacaaattcccaaagaaacacggtgtactctagacaaagtgaatagcctagaagacgtggaacgacgacgggtntgtgtattacgtgtgacgtaggtaggtcgggtttcgacgttacggtccggttccgggtccccgggggtaccgggttaccccgttaagggttaccgaaacgtacgttaacggtaaaccgttaacgttacccgtaaccgtttaacccggtaacggg

SEQ ID NO: 332865 - DNA, 506 bp, Homo sapiens
  misc_feature: GZ8MTXP01CXCZ6.3.75.G09.1.454.CMB.2.raw
  modified_base (256)..(256): a, c, t, g, unknown or other
  misc_feature (256)..(256): n is a, c, g, or t
  modified_base (378)..(378): a, c, t, g, unknown or other
  misc_feature (378)..(378): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagcctgggaggtccctgagactctcctgtgcagcctctggcttcatcttcagtagctaataaaatgcactgggtccncaggctccaggcaaggggctggagtgggtgcacttattcatatgatggaagacagatactgcagactcgtgaacgggccgaagtcaaccatctccagagacaaattcaagacacggtgtctntgcaagtgaaatagcctgagacgtggaacgcacgggctgtgtattactgtgcgagagtagggtttcgcagtcgccggtccgggcgggcccaggttcgaacatcgactattcaacttaacgttaaccgg

SEQ ID NO: 332866 - DNA, 595 bp, Homo sapiens
  misc_feature: GZ8MTXP01BT8B6.3.75.G09.1.454.CMB.2.raw
  modified_base (259)..(259): a, c, t, g, unknown or other
  misc_feature (259)..(259): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagcctgggaggtccctgagactctcctgtgcacgcctctggcttcatcttcagtagctaataaaatgcacgtcgggtccnccgaggctccgaggcgaaggggctgggagtgggtggctacgtttattcatatgagtggaaagacagatactcgacacgactcgtaggaacggccgaacgtcaaccatccaccgaagaacgaacctaaattacccgaaagaacgtacggtagtcctacgtgacaaggtagaaactacgcctagaagacgtcgggaacgacgacggcttagtctagttacgtgtaggcggtagtacggtacggggtttcgcgacggtccgttccggtacccggggccgggacccttagggttacaaacgtcgtaacgactacgttaccgtaaccgttcggtaacccgg

SEQ ID NO: 332867 - DNA, 527 bp, Homo sapiens
  misc_feature: GZ8MTXP01AHC6M.3.75.G09.1.454.CMB.2.raw
  modified_base (254)..(254): a, c, t, g, unknown or other
  misc_feature (254)..(254): n is a, c, g, or t
  modified_base (454)..(454): a, c, t, g, unknown or other
  misc_feature (454)..(454): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggagcgtggtccagcctgggaggtccctgagactctcctgtgcagcctctggcttcatcttcagtagctaataaatgcactgggtccncaggctccaggcaaggggctgggagtggggtggctacttattcatatgatggaagaacagatactcgcacgactcgtgaaggccaagtcaaccatctaccagagactaattaccaaagaacacggtgtactctgacaagtgaaatagcctagagacgtggacgacacggctgtgtatacgtgtagcgagaggtgggttcncgagccgttcggtccgggcggcccgttaggttcgaaacagtcgacttacttactaacgttaacgttaaccggg

SEQ ID NO: 332868 - DNA, 637 bp, Homo sapiens
  misc_feature: GZ8MTXP01BG6Y0.3.75.G09.1.454.CMB.2.raw
  modified_base (218)..(218): a, c, t, g, unknown or other
  misc_feature (218)..(218): n is a, c, g, or t
  modified_base (260)..(260): a, c, t, g, unknown or other
  misc_feature (260)..(260): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggaggcgtggtccagcctggggaggtccctgagactctcctgtgcagcctntggcttcatcttcagtagactaataaaatgcacgtgggtccncagggctcgaggcgaaggggctgggaggtgggtggctacttattcatatgatgggaaaggacagatacttcgacacgactccgtggaacgggccgaacgtccaaccatctaccagtacgaactaaattacccgaaagaactaccgggtgtacctccgtagaccaaaggttgaaagttacggccgttaggaacggtaaccggtggggaaccgacgacggtcgttggttcgttaacttacgtggtacggacggtaggtacggtaaggggtttccgcgttacggtcgttccgggtcccggggtaccgggccccgttaggttacggaaaccctgtaacggtaaccttacttaccccgttaagttaacccggttaaccgggg

SEQ ID NO: 332869 - DNA, 553 bp, Homo sapiens
  misc_feature: GZ8MTXP01AJR5O.3.75.G09.1.454.CMB.2.raw
  modified_base (258)..(258): a, c, t, g, unknown or other
  misc_feature (258)..(258): n is a, c, g, or t
  modified_base (398)..(398): a, c, t, g, unknown or other
  misc_feature (398)..(398): n is a, c, g, or t
  modified_base (476)..(476): a, c, t, g, unknown or other
  misc_feature (476)..(476): n is a, c, g, or t
tcagagacgcactccacgaccggtgctcgatttagtatagacatcaggggggacactgagtgtgagtgaacatgagtgagcaaaactggatttgtgtgccattttctgataacggtgtccttctgtttgcaggtgtccagtgtcaggtgcagctggtgcaggtcggggggaggcgtggtccagcctggggaggtccctgagactctcctgtgcagcctctggcttcatcttcagtagctaataaatgcacgtggtccncaggctcaggcgaaggggctggagtgggtggctactttattcatatgatggaagaacagatactcgacacgactcgtaggaacgggccgaaagtcaacctatcctacagaacgactaattaccaagaacacggtgtctcngacaagtgaatagcctagacgacggtaggaacgacgacgtcttgtacgtattacgtgtgacggagtaggtagggttcncgaggtcttcgggtccgggcgggcccgttaggttacggaactagtcgtactacgttcctaacgttcggttaaccggg

SEQ ID NO: 332870 - DNA, 571 bp, Homo sapiens
  misc_feature: GZ8MTXP01A7DH9.3.75.G09.1.454.CMB.2.raw
  modified_base (257)..(257): a, c, t, g, unknown or other
  misc_feature (257)..(257): n is a, c, g, or t
  modified_base (490)..(490): a, c, t, g, unknown or other
  misc_feature (490)..(490): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggcccagcctgggagtccctgagactctcctgtgcagcctctggcttcatcttcagtagctaataaaatgcacgtcgggtccncaggctccgaggcaaggggctgggagtgggtgctactttattcatatgagtagggaaggaacagatacttcgcacggacctccggtaggaacgggcccgaagtccaaccgatcctaccagagacaattcccaaagaacacggtgtctctgacaagtagaatacgcctaggacgacgtaggaacgacgacgggtctaggtgttattacgtggtagcgaggtagggtagggttcncgttaggcgttccggtaccgggccgggttcccttaggttcgaactgtaacgactacttccgtaacgttaacccgtaacggg

SEQ ID NO: 332871 - DNA, 564 bp, Homo sapiens
  misc_feature: GZ8MTXP01BFDBZ.3.75.G09.1.454.CMB.2.raw
  modified_base (260)..(260): a, c, t, g, unknown or other
  misc_feature (260)..(260): n is a, c, g, or t
  modified_base (412)..(412): a, c, t, g, unknown or other
  misc_feature (412)..(412): n is a, c, g, or t
  modified_base (490)..(490): a, c, t, g, unknown or other
  misc_feature (490)..(490): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggaggcgtggtccagccgtgggaggtccctgagactctcctgtgcagcctctggcttcatcttcagtagctaataaaatgcacgtgggtcccnccaggctccgaggcgaaggggctgggagtgggtggctactttatttcatatgagtaggaaggtaacagatacttcgcacgactcggtaggaacgggccgaagtccaaccatcctccaagacgaacaaattacccaaagaacacggtgtctcngacaagtagaatcgcctaggacgacgtggaacgacgacggctagtgtacttagtgtgcggtagaggtcgggttcacgnggccgttccggcccggggccggcccgaggttcgaactggtaacacgtacttactaaccgttaacgttaaccggg

SEQ ID NO: 332872 - DNA, 741 bp, Homo sapiens
  misc_feature: GZ8MTXP01A094Z.3.75.G09.1.454.CMB.2.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcgaggtcgggggagcgtggtccagccgtgggacgtccctgagctctctgngcagcctgtgtcttcatcttcagtanactaataaatcgacacgtcggtccnccgaggctcgaggacgaaggggcgtagggaggtgggtcggcgtaactttagtttacagttagtagagtagggaaaggaacgtagtaacgttacgttcgacgtaaccgtaccgtaccggtagggaaacgggccgaaacgtacccgaacctactccgtaccgagtaacgaacctaaacttaacccgaaacgtaaccgtacggttacggtaccttacgtaggtacctaaagggtttacgaaacgtcggaccgttaggacggtacgtacggggaaccgacggtaccggtacgttaggttacgtttaagttaccggtagtccgggtacggtaaggtaggggttacggggtttccgacggttacgggtccccggtttccggggaccccgggggtaccccgggttaccccggttaaggttccggaaaacccgttagtaaccggtaaccttacgttacccgttaaccgtttaacccgggtttaacccgggg

SEQ ID NO: 332873 - DNA, 667 bp, Homo sapiens
  misc_feature: GZ8MTXP01ES5LI.3.75.G09.1.454.CMB.2.raw
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcgaggtcggggggagcgtggtccaggccgtgggagtccctgagactctcctgtgcagcctcgtggcttcatcttcagtanctaataaatgctacgtcggtccncgaggctccgaggcgaaggggctgggagtgggtgctactttattcatatgagtaggaaaggaacagactactcgacacgaccgtcggtaggaacgggccgaaagtaccaacctactaccgtaccaagaacggtaaacaaactttaacccgaaagtaaccgtacgggttacgtactaccgtaggtaaccgtaaaggttacgaaacgttaacggacccgttaggaaacgtacggttacgggggaaccgtaacggaacggttcgttagtcgttaacttacggtaggtacgtacggtaaggtacgggtaagggtttcgacgttaggtcccgttcgggtaccccggggtcgggacccgttggttacggaactagtaacggtactacgttacccgtaacgttcgttaaccggg

SEQ ID NO: 332874 - DNA, 592 bp, Homo sapiens
  misc_feature: GZ8MTXP01EQBYG.3.75.G09.1.454.CMB.2.raw
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (345)..(345): a, c, t, g, unknown or other
  misc_feature (345)..(345): n is a, c, g, or t
tcagagacgcactccacgaccggtgctcgatttagtatagacatcaggggggacactgagtgtgagtgaacatgagtgagcaaaactggatttgtgtgcctattttctgataacggtgtccttctgtttgcaggtgtccagtgtcaggtgcagcgtggtgcgagggtcggggggagcgtggtccagccgtgggacgtcctgacgactctcgtgtgcagcctntggtcttcattcttacgagtagacttaaataaaatcgacacgtcgggtcccgccaggctccgaggcagggcnggagtggtggcttattattcatatagatgggaaaggaacagatacttacgnaacggactcgtagaacggccgaatccaaccatccaccagacgaacaaacttccaaagaacacggtgtctacgtgacaagtagaaatacgcctaggaagacggtaggaacgaacgacggtactgtagtacttacgtgtgtacggtagaggtagggtttcgcgacggtccgttccggtcccggggccgggacccgaggttacggaacctagttaacgtaacttacgttacctaacgttaaccgtaacgg

SEQ ID NO: 332875 - DNA, 668 bp, Homo sapiens
  misc_feature: GZ8MTXP01CP75T.3.75.G09.1.454.CMB.2.raw
  modified_base (277)..(277): a, c, t, g, unknown or other
  misc_feature (277)..(277): n is a, c, g, or t
tcagagacgcactccacgaccggtgctcgatttagtatagacatcagggggacactgagtgtgagtgaacatgagtgagcaaaaactggatttgtgtgcctatttttctgataacggtgtccttctgtttgcaggtgtccagtgtcaggtgcagctggtgcgagggtcggggggagcgtggtccagccgtgggacggtccctgagactctcctgtcgcagtcctcgtggcttcattcttacgagtagacttaaataaatgacctacgtcgggtcccncgaggctaccgaggcgaaggggcgtgggaggtgggtcggactactttagttcaagtgtagagtagggaaagacagtactacgtcgacacgacgtcggtaggaacgggcctaacgtccaacctatacccacgagaacgactaaacgtaaccaaacggtaacgtacgggttactaccgttacgtagaacgtaagttacgaacgttacggaccgttaggaacgtacgggtacggaaccgtacggtaccggtgttacgttagttaccgttagtggtcggaggaaggttacgggtcggttaacgacgttcgggcccgttaccggggccgggtccggacccgttaggttacgaaccgtgtaaccgtacttacgttacctaacgtttcggtaaccggg

SEQ ID NO: 332876 - DNA, 637 bp, Homo sapiens
  misc_feature: GZ8MTXP01CUGPV.3.75.G09.1.454.CMB.2.raw
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (286)..(286): a, c, t, g, unknown or other
  misc_feature (286)..(286): n is a, c, g, or t
  modified_base (416)..(416): a, c, t, g, unknown or other
  misc_feature (416)..(416): n is a, c, g, or t
  modified_base (529)..(529): a, c, t, g, unknown or other
  misc_feature (529)..(529): n is a, c, g, or t
  modified_base (606)..(606): a, c, t, g, unknown or other
  misc_feature (606)..(606): n is a, c, g, or t
tcagagacgcactccacgaccggtgctcgatttagtatagacatcagggggacactgagtgtgagtgaacatgagtgagcaaaactggatttgtgtgccatttttctgataacggtgtccttctgtttgcaggtgtccagtgtcaggtgcagctggtgcaggtcgggggagcgtggtccagcgtgggagtccctgagactctcctgtncagcctntgcttnatcttacagtagactaataaatgctacgtgggtccacgaggctccgaggacgaaggggtctgggngtggggtggactactttattcattagtagacgtagggaaagacagtactacgtcgacgacgactacggtaggacgggccgaagtccgaactactcctaccgaagacactaacttacaaagtactacggtntctacgagacaagttgaactacgccgtaaggacgacggtaggaaccgtacgtacggtcgttagttacgttacgttacgcggttaggaccggtaggtacgggttacgggtttcncggaggttcccgttccgggtacccggggtccgggacccgttagggtttacgaaccgtaagttccggtaaacccgttnttacccgtaacgttaacggtttaacccgggg

SEQ ID NO: 332877 - DNA, 752 bp, Homo sapiens
  misc_feature: GZ8MTXP01BLOP0.3.75.G09.1.454.CMB.2.raw
  modified_base (396)..(396): a, c, t, g, unknown or other
  misc_feature (396)..(396): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccggtgtcaggtgcagctggtgcgaggtcggggggagcgtggtccagccgtgggacgtccctgagactctcctgtgcagtcctcgtggtcttcatcttcagtacgactaataaatcgctacgtcgggtcccgcaggcctccgaggcgaaggggcgtaggaggtgggtcggctactttagtttcatagtgaagtagggaagaactagtacttacgtcgacgacgtaccccgtccggtaggaacgggccgacgtacccaaccngttcccaccgaaggaacgaactaaaccgttaccgaaaacgtaaccgtacgggttacgtccgttacgtacgtaaccgtaaagggtaacgtaacgtaacggacccgttaggaaccggtaaccgggttaccgggaaacccggggtaaaccggtaccccggggtttacgttacgggtttaagtttaacgtttaaccgggttgggtaacccggggtaggggtaaacgggttaacgggggtttacggggtttccggaaccggttcgggttccccggttccggggttacccgggccggggtacccttaggttcgaaccgtgtacgtaactactaccgttaaccgtccggttcggttaaccggg

SEQ ID NO: 332878 - DNA, 764 bp, Homo sapiens
  misc_feature: GZ8MTXP01DLG0V.3.75.G09.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcgaggtcggggggagcgtggtccagcctgggacggtccctgacgctctcctgtgcagcctntgcttcatctcagtanactaataaatgcacgtgggtccncgaggcctccgaggcgaaggggctggagtgggtgctactttattcattatgagtgggaaaggactagtacttacgtcgacgtaacgaccgtccggtaggaaacgggcccgtaaagttcccaaccaattccctaccgaaagaaccgtactaaacgttacccaaagtaaccgtacggtcgtcgtacgtcggaactaaaggttacgaaacgttacggacccgttaggaaacggttacccgggtaagggaaccccgggaaaccggtacgggttaccgttaggtaacccggtttaatttaccggagggttccggaaacgggtaacgggtaaaggggtttccgggggttttaaccgaacgggttacccgggtccggttaccccgggggttccccgggggaacccgggggttaaccccgttagggggtttaaaaccgaaaccgtaagggtttaaccgtaaaccgtttaaccgttacccgttaaaaccggtttaacccgggtttaaacccggggg

SEQ ID NO: 332879 - DNA, 556 bp, Homo sapiens
  misc_feature: GZ8MTXP02GI8US.3.75.G09.1.454.CMB.2.raw
  modified_base (256)..(256): a, c, t, g, unknown or other
  misc_feature (256)..(256): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagcctgggaggtccctgagactctcctgtgcagcctctggcttcatcttcagtagctaataaaatgcactgggtccnccaggctccgaggcaaggggctggagtgggtggctacgttatttcatatgatgggaaaggacagatactgcagactcgtagaacggcagtcaccatctacagagacaatccaaagaacacggtnctntgacaagtgaatagctgacgagtagacgacgacggtctagtagttacttacgtggtacgacggaaggtaggtaacggggtttcgacgtacggtccgttccggtaccggggtccgggacccgtaggttacgaaaccgtagtacgtactactaccgtaacgttacgttaaccggg

SEQ ID NO: 332880 - DNA, 615 bp, Homo sapiens
  misc_feature: GZ8MTXP02GGJKO.3.75.G09.1.454.CMB.2.raw
  modified_base (253)..(253): a, c, t, g, unknown or other
  misc_feature (253)..(253): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcgggggagcgtggtccagcctgggagtccctgagactctcctgtgcagcctctggcttcatcttcagtagctaataaatgcactgggtccnccaggcctccgaggcgaaggggctgggagtggggtggctactttatttcatatgatagggaaaggaacagatactcgcacgactccgtggaacgggccagtcaccatcctaccagacgaacaaattacccaaagaacgtacggtgtctacgtgactaaagtagaaagtacgaccgtagaacgacggttagacgacgacgggtcttaggttagtagtttacgtggtacgacggtaaggtagggttaacggggtttcggacgtaggtcccgtttcccggggcccggggtacccggggtaccccgtaaggtttacgaaaccgtagtacggtaaccttagtaccctaaccgttaacggttaccggg

SEQ ID NO: 332881 - DNA, 558 bp, Homo sapiens
  misc_feature: GZ8MTXP02GW0NE.3.75.G09.1.454.CMB.2.raw
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcgggggagcgtggtccagcctgggagtccctgagactctcctgtgcagcctctggcttcatcttcagtagctaataaatgcactggtccgccaggctccaggcaaggggctggagtgggtggcacttattcatatgatggaaagaacagatactcgcagactccgtagacgggccgagtcaccatctaccgagacgaactaacttaccaaagaaacacggtgtactctgacaagtagaatacgcctagagacgtagaacgacgacggtctagtagttaatcgtgtgacgagtaggtacggggtttcacgtagccgtccgggtcccgggccgggtaccccgtaggttacgaaaccgtagtcggtaaactactaccaaccgtttaacgttaacccggg

SEQ ID NO: 332882 - DNA, 559 bp, Homo sapiens
  misc_feature: GZ8MTXP02JR65U.3.75.G09.1.454.CMB.2.raw
  modified_base (266)..(266): a, c, t, g, unknown or other
  misc_feature (266)..(266): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (343)..(343): a, c, t, g, unknown or other
  misc_feature (343)..(343): n is a, c, g, or t
  modified_base (408)..(408): a, c, t, g, unknown or other
  misc_feature (408)..(408): n is a, c, g, or t
  modified_base (470)..(470): a, c, t, g, unknown or other
  misc_feature (470)..(470): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtgaggtgcacctggtggagtcgtgggggaggcttggtccagcctgggacgggtccctaagactctcctgtgcagcctctggactcaccttcacgctcaatggccactacgtggactggggtcccncaggcctcgaggggagggctggngtgggtgccgttnagagacacaactacngtgaccaccgnaacaaactccgccgngtccgtgagaaaggcagattcacctatctacaaagagatgattacaagaacaactctaactttanctagacaaaatgaaaccagtcctagaacgaacccgagacaccggggcctagttattagttgntacagtacgactaaggactacgaacgtcggtacgtacctgggtacttcggaacggttggtactacggtcggggaccaaggggaccctgg

SEQ ID NO: 332883 - DNA, 605 bp, Homo sapiens
  misc_feature: GZ8MTXP02I962Q.3.75.G09.1.454.CMB.2.raw
  modified_base (257)..(257): a, c, t, g, unknown or other
  misc_feature (257)..(257): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcgaggtcggggggagcgtggtccagcctgggagtccctgagactctcctgtgcagcctctggcttcattcttcagtagctaataaatgcacgtgggtccncaggctccaggcaaggggctggagtgggtggctactttatttcatatgagtagggaagaacagatactcgcagactccgtagaacggccgagtcaccatcctaccagacgaactaaacttaccgaaagaaccgacggttgtacctcgttagactaaggtacgaaatacgactaggaacgacggtacggacgacgacggtcttaggtgttaacgttacgnggttacggnggtaaggtaggttacggggtttcacgtggtccgtaccgggttcccgggcggggtaacccctaggttaacggaactacgttacggtaccttaagtacccgtaacgtttaacgtttccgggg

SEQ ID NO: 332884 - DNA, 497 bp, Homo sapiens
  misc_feature: GZ8MTXP02JQMH9.3.75.G09.1.454.CMB.2.raw
  modified_base (310)..(310): a, c, t, g, unknown or other
  misc_feature (310)..(310): n is a, c, g, or t
  modified_base (446)..(446): a, c, t, g, unknown or other
  misc_feature (446)..(446): n is a, c, g, or t
  modified_base (484)..(484): a, c, t, g, unknown or other
  misc_feature (484)..(484): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcgggggagcgtggtccagcctgggaggtccctgagactctcctgtgcagcctctggcttcatcttcagtagctataaaatgcactgggtccgccaggctccaggcaaggggctggagtgggtggcacttattcatatgatggaagaacngatacttcgcacgactccgtgaacgggccagtcaccatctccagagacaattcaaagacacggtgtctctgcaagtgaatagcctgagacgtgacgacacggctgtgtattacgtgtgcgagagtagggtttcgangctcggcggcggggcccaggttgaactgtacgactacncaactacgtacgg

SEQ ID NO: 332885 - DNA, 554 bp, Homo sapiens
  misc_feature: GZ8MTXP02F8LUR.3.75.G09.1.454.CMB.2.raw
  modified_base (254)..(254): a, c, t, g, unknown or other
  misc_feature (254)..(254): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcgggggagcgtggtccagcctgggaggtccctgagactctcctgtgcagcctctggcttcatcttcagtagctaataaatgcactgggtccncaggctccaggcaaggggctggagtgggtgcacttattcatatgatggaagaacagatacttcgcacgactccgtagaaacgggccgagtcaccatctaccagagacaattccaaagaacacggtgtctctgacaagtgaaatacgcctgaagacgtgacgacacggctgtacgtattacgtggtcgcggaagtaggtacggggtttcgcgtaggtccgttcggggtcccggggtccggggacccctaggttacgaaaccgtagtcggtaactactcgtaaccgttaaccgttaccgggg

SEQ ID NO: 332886 - DNA, 538 bp, Homo sapiens
  misc_feature: GZ8MTXP02HDT6F.3.75.G09.1.454.CMB.2.raw
  modified_base (257)..(257): a, c, t, g, unknown or other
  misc_feature (257)..(257): n is a, c, g, or t
  modified_base (327)..(327): a, c, t, g, unknown or other
  misc_feature (327)..(327): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggaggcgtggtccagcctgggaggtccctgagactctcctgtgcagcctctggcttcatcttcagtagctaataaaatgcactgggtccnccaggctccaggcgaaggggctggagtggggtggctactttatttcatatgatggaaggacagatatcgnacgactccgtgaagggccgagtcaccgatctccagagacaattaccaaagaacacggtgtctctgacaagtgaatagcctgagacgtagacgacacggcgtagtcgtattacgtgtgcgagaggagggtttcgcgtagcgtccggtccgggtccgggcccgtaggttacgaacgtagtacggtaactactaccgtaacgttaccgttacgg

SEQ ID NO: 332887 - DNA, 622 bp, Homo sapiens
  misc_feature: GZ8MTXP02F7HW5.3.75.G09.1.454.CMB.2.raw
  modified_base (253)..(253): a, c, t, g, unknown or other
  misc_feature (253)..(253): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcgggggagcgtggtccagcctgggagtccctgagactctcctgtgcagcctctggcttcatcttcagtagctaataaatgcacgtggtccnccaggcctccgaggcaaggggctgggagtggggtgctactttattcatatgatgggaagacagatactcgacacgacctccgtagaacggggccaagtccacctatcctccgaagacgaactaaacttacccgaaaagaaccgtacggttcgtacctacgtgacaaaggtcgaaagtacgcccgtaggaacggtaacggtggaaccgacgacggtcttaggtacgttacttacgtggtacggcggtaaggtaggttacggggtttccgacgtacgggtccgttccggggtacccggggccgggtaccccgttaaggttacggaaaccgtacgtacgaaccttactaccgtaacgtaccggtttaccggg

SEQ ID NO: 332888 - DNA, 542 bp, Homo sapiens
  misc_feature: GZ8MTXP02JAZ75.3.75.G09.1.454.CMB.2.raw
  modified_base (346)..(346): a, c, t, g, unknown or other
  misc_feature (346)..(346): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggaggcgtggtccagcctgggaggtccctgagactctcctgtgcagcctctgacttcatcttcagtagctataaatgcactgggtccgccaggctccaggcaaggggctgggagtggggtggctacttattcatatgatggaaggacagatactcgcagactccgtgaagggccagtcnccatctcagagacattccaaagacacggtgtctctgacaagtgaatagcctgagacgtagacgacacggctagtgtattacgtgtgcgagaggtagggtttcgcgaggccgtccgggtcccgggccggggtaccccgtaggttacggaaaccgtagttacggaaccttaagtacctaaccgttacgtttaaccggg

SEQ ID NO: 332889 - DNA, 572 bp, Homo sapiens
  misc_feature: GZ8MTXP02IZGMM.3.75.G09.1.454.CMB.2.raw
  modified_base (261)..(261): a, c, t, g, unknown or other
  misc_feature (261)..(261): n is a, c, g, or t
  modified_base (325)..(325): a, c, t, g, unknown or other
  misc_feature (325)..(325): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (446)..(446): a, c, t, g, unknown or other
  misc_feature (446)..(446): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggaggcgtggtccagcctgggaggtccctgagactctcctgtgcagcctctggcttcattcttcagtagactaataaatgcacgtggggtcccnccaggcctccgaggcgaaggggctggagtggggtgctacgtttattcatatgatgggaaagaanagtatactcgacacgacgtcgtagacgggcagtcaccntcctacaganaacgaattccgaaagaacgtacgtgactctagacgtagtagaatagccgtagacgtacgtgaacacgacggtnttagtattagtacgtgtcgacggaagtgggtacggttcgacgacggtccgtacgggttcccgggaccgggtaccgtagttaaccggaactagtacggtactacgtacctaacgttaacgttccggg

SEQ ID NO: 332890 - DNA, 531 bp, Homo sapiens
  misc_feature: GZ8MTXP02FK0MF.3.75.G09.1.454.CMB.2.raw
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (420)..(420): a, c, t, g, unknown or other
  misc_feature (420)..(420): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggaggcgtggtccagcctgggaggtccctgagactctcctgtgcagcctctggcttcattcttcagtagctaataaatgcactgggtccnccaggctccgaggcaaggggctggagtgggtctnatcattagtagtagtagtagtanatatactagcagacctcagtgaagggcattcaccntctcaganacaacgccaaagactcactgtatctgacaaatgaaacagcctagagaggaccgagacgacggntgtagtagttactgtgtcgtaggtttggtttggggcggtatacggcgacgggccgggaccggggtcaacgtaacgtacgtacggtacgtggtacgtcggtcggggaacccg

SEQ ID NO: 332891 - DNA, 494 bp, Homo sapiens
  misc_feature: GZ8MTXP02FG0P3.3.75.G09.1.454.CMB.2.raw
  modified_base (345)..(345): a, c, t, g, unknown or other
  misc_feature (345)..(345): n is a, c, g, or t
tcagagacgcactccacgaccggtgctcgatttagtatagacatcaggggacactgagtgtgagtgaacatgagtgagcaaaactggatttgtgtgccatttctgataacggtgtcctctgtttgcaggtgtccagtgtcaggtgcagctggtgcaggtcggggtaggcgtggtccagcctggaggtccctgagactctcctgtgcagcctctgacttcatcttcagtagctaataactgcactggtccgccaggctccaggcaaggggctggagtggggtggcactttattcatatgatgggaaaggaacagatacttcgcagactccgtgaagggccgagtcnccatctccagagacaaattccaaagaacacggtgtctctgcaagtgaatagcctgagacgtgacgacacggctgtgtattactgtgcgagagaggggtttcgcagctcggtccggcgggcccagttgaacatgactatcactactacgg

SEQ ID NO: 332892 - DNA, 637 bp, Homo sapiens
  misc_feature: GZ8MTXP02GNOX3.3.75.G09.1.454.CMB.2.raw
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagccgtgggaggtccctgagactctcctgtgcagcctctggcttcattcttcagtagacttaaataaaatgacacgtcgggtcccgccaggcctccgaggacgaaggggctgggaggtggggtggctactttagttcatagtgaagtaggaaaggaacagtatactcgacacgacgtccgtaggaacgggccgaagtccacctacgtcctaccgagaacgaactaaacgttacccaaaagaaccgtacggttagtcctctagaccaaggttagaaactacgaccgtaggaacggtacgtagaaccggacgtaccggtcgttagttacgttaacttacgtgtacggacggaaggtagggttacggggttccgacgtacggccggttccggtcccggggccggtacccgtagttacgaaacgtacgtcgtaactacgtactaaccgttacgttaaccggg

SEQ ID NO: 332893 - DNA, 671 bp, Homo sapiens
  misc_feature: GZ8MTXP02GB8QL.3.75.G09.1.454.CMB.2.raw
  modified_base (261)..(261): a, c, t, g, unknown or other
  misc_feature (261)..(261): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcgaggtcggggggagcgtggtccagccgtgggagtccctgagactctcctgtgcagcctgtggtcttcattcttcagtagctaataaatgcacgtcgggtcccnccgaggcctaccgaggcgaaggggctgggaggtgggtgctactttattcatagtgagtagggaaagacagatactcgacacgaccgtcggtaggaacggccgagtccacatcctacagacgaactaactaccgaaacgaacgtacggtcgtaccacgtagaactaacggtagaaacgtcggacccgtagggtaaacgtaccggtacggaacccggtaaccggtaccgggttacgtttaaggttacgtttaaacgtttccggtagggtacggtacgggtaaggggttacggggttaacggggtttccggaacgtccgggtccgggttacccggggtccggggtcccggggtaaccctaggttaacggaaactacgtagtacctacgtactaaccgttaccggttaacgggg

SEQ ID NO: 332894 - DNA, 564 bp, Homo sapiens
  misc_feature: GZ8MTXP02FIBGO.3.75.G09.1.454.CMB.2.raw
  modified_base (260)..(260): a, c, t, g, unknown or other
  misc_feature (260)..(260): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagccgtgggagtccctgagactctcctgtgcagcctctggcttcattcttcagtagctaataaaactgcacgtgggtcccncaggctccgaggcaaggggctgggagtggggtgcactttattcatatgatgggaaagaacagatactcgcacgacctccgtaggaacggccgagtccaccatcctaccagacacaaacttaccaaagaaacacggtgtctctagacaaagtagaaatacgccgtagagacgtgacgacacggtctgtacgttattacgtgtacgacggaagtaggtacgggtttcgacgtaggccgtccgggtaccgggccggggtacccaggtttacgaaaccgtatacgactagtccaactaccgttaacgg

SEQ ID NO: 332895 - DNA, 678 bp, Homo sapiens
  misc_feature: GZ8MTXP02H9P4L.3.75.G09.1.454.CMB.2.raw
  modified_base (217)..(217): a, c, t, g, unknown or other
  misc_feature (217)..(217): n is a, c, g, or t
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
tcagagacgcactccacgaccggtgctcgatttagtatagacatcagggggacactgagtgtgagtgaacatgagtgagcaaaactggatttgtgtgccatttttctgataacggtgtccttctgtttgcaggtgtccagtgtcaggtgcagctggtgcaggtcggggggagcgtggtccagcctgggaggtccctgagactctcctgtgcagcctntggctttcatcttcagtagctaaataaatgacacgtgggtccnccaggcctccgaggcgaagggctggaggtgggngctactttagttcatatgataggaaagacagatactcganacgacctacggtggaaacggcgtagtacaccgtatacctaccgagaacgtaacaacttaacccgaaacgtaaacgacggtactacctacgtgaaacgtaagtagaaacgtaccgaccgttaaggacggtaaacgttcggaaaccggtaacgaccgggtgttaacgtcgttaaagtttaccgtagggttacggaccgggtaagggtacggggttaaccggtttcggaacgtacccggtcctttccgggggtccccggggacccggggtaccctttaagggttaccgaaaccgttacgtaccggaaaaccttacgttaccccgaaactttaacccggtaaccggggg

SEQ ID NO: 332896 - DNA, 624 bp, Homo sapiens
  misc_feature: GZ8MTXP02HREHU.3.75.G09.1.454.CMB.2.raw
  modified_base (259)..(259): a, c, t, g, unknown or other
  misc_feature (259)..(259): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagccgtgggaggtccctgagactctcctgtgcagcctctggcttcatcttcagtagctaataaaatgcacgtcgggtccnccaggcctccgaggcgaaggggctggaggtgggtgctacgtttattcatatggatagggaaaggaacaagacttacgttcgactacgtacctccggtaggaacggggctacgtcacctatctaccgagacgaacaattacccgaaagacgacggtntactctagactagtanaactcgcctaggacgtaccggtagaacgacgtacggtcgtagttagtaagttcgtggtacggaggtaggtagggttacggggtttccacggaccgggtcccccgggtaccgggggaccggaccccgtaacggttacgaaaccgtaagttacggaaacttacgtacctaacccgtaacggtttcggttacccgg

SEQ ID NO: 332897 - DNA, 590 bp, Homo sapiens
  misc_feature: GZ8MTXP02HX10J.3.75.G09.1.454.CMB.2.raw
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
  modified_base (431)..(431): a, c, t, g, unknown or other
  misc_feature (431)..(431): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (517)..(517): a, c, t, g, unknown or other
  misc_feature (517)..(517): n is a, c, g, or t
tcagagacgcactccacgaccggtgctcgatttagtatagacatcagggggacactgagtgtgagtgaacatgagtgagcaaaactggatttgtgtgccatttttctgataacggtgtccttctgtttgcaggtgtccagtgtcaggtgcagctggtgcaggtcggggggaggcgtggtccagccgtgggaggtccctgagactctcctgtgcagcctntggcttcattcttcagtagactaataaatgcacgtcggcccncaggcctccgaggccgaaggggctggaggtgggtcgctacgtttatttcaattagtggatagggtaaaggaaacaggtaacttaccgtcgacaccggtactccggtaggaacggggctagtaccaccgtactcaccaggaactacaaattacccgaaagaccgtacggtntcctctacgactaaggttagaaactacgccgtagacgacgtgacgaacacgggtntgtagtacgtgngngagtagtaggtcggtcncgacggccgtccggggccggaccgtaccgtaagtacgaacgtagtacgactactacgtaaccgttacggtcgg

SEQ ID NO: 332898 - DNA, 630 bp, Homo sapiens
  misc_feature: GZ8MTXP02JCIV7.3.75.G09.1.454.CMB.2.raw
  modified_base (267)..(267): a, c, t, g, unknown or other
  misc_feature (267)..(267): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcgaggtcggggggaggcgtggtccagccgtgggacggtccctgagactctcctgtgcagcctctggtcttcattcttcgagtagactaataaatgacacgtcgggtcccncgaggcctccgaggcgaagggctggaggtgggtgctactttatcatatgagtagggaaagacagactacgtcgacacgtactcgtagaacgggcagcaccgtatcctaccgaagacgaactaaacttaccgaaagaacctacggttactcgtacgtacgactaaggtaacgaaagtacgccgttaggaacgtacgtacggaaccgacgacggtcgttaggtagttacgttacgtggtagacggtaggtacggtacggggtttcacggacgtccggtccgggccggggtaccggtaccctaaggttacgaaaccgtagtaaccggtaacttacgtacccgtaaacgttaccggtttaaccgggg

SEQ ID NO: 332899 - DNA, 722 bp, Homo sapiens
  misc_feature: GZ8MTXP02JAAN4.3.75.G09.1.454.CMB.2.raw
  modified_base (258)..(258): a, c, t, g, unknown or other
  misc_feature (258)..(258): n is a, c, g, or t
  modified_base (309)..(309): a, c, t, g, unknown or other
  misc_feature (309)..(309): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggaggcgtggtccagcctgggagtccctgagactctcctgtgcagcctctggcttcatcttcagtagcttaataaatgcacgtgggtcccnccaggcctccgaggcgaaggggcgtggaggtgggtgctactttatttcatntgagtagggaaaggaacagtaattaccttcgacagtacccgtccgtaggaacggggccgtacgtccacctatccctaccgaacgaacgtaactaaacgttacccgaaaagtaaccgtacggttacgtccttacgtagtaccgtaaaggtagtaaagtaacggtcccgtagaacggtaaccgttacggaaccgtaaccgtacgggtactttacggttgttaaaacgttttccggtgggttaacgggaccgggtaaagggtaaacgggggtttcgggtttaccgaccggttaacggttccccgggttacccggggtcccgggggaccccgggggtaccccttaagggtttaccggaaaaccgtgttaccggtaaacctacgttaacccgtaccgtttaaaccggtttacccgggg

SEQ ID NO: 332900 - DNA, 570 bp, Homo sapiens
  misc_feature: GZ8MTXP02IFBRY.3.75.G09.1.454.CMB.2.raw
  modified_base (264)..(264): a, c, t, g, unknown or other
  misc_feature (264)..(264): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (425)..(425): a, c, t, g, unknown or other
  misc_feature (425)..(425): n is a, c, g, or t
tcagagacgcactccacgaccggtgctcgatttagtatagacatcagggggacactgagtgtgagtgaacatgagtgagcaaaaactggatttgtgtgccattttctgataacggtgtccttctgtttgcaggtgtccagtgtcaggtgcagctggtgcaggtcggggggaggcgtggtccagccgtgggacggtccctgagactctcctgtgcagcctctggcttcatcttcagttagctaataaatgacacgtggggtcccnccgaggcctccgaggacgaagggggctgggaggtgggtgctactttattcatatgagtagggaaagaacagtattactcgcacgtaccgtcgtaggacggcgagcncntcncanacacactacaagacnggtntctngacagtanaatcgctgagtaccgngacgacgacgcgttagtgttactacgttggacgagggtaggtacgggtcggggtttacacggtccgtccgggtcccgggccgggggtaccgggacccgttagttacgaaacgtgtacggtactactcctaaccgttacgttacgg

SEQ ID NO: 332901 - DNA, 673 bp, Homo sapiens
  misc_feature: GZ8MTXP02HHSKS.3.75.G09.1.454.CMB.2.raw
  modified_base (264)..(264): a, c, t, g, unknown or other
  misc_feature (264)..(264): n is a, c, g, or t
  modified_base (358)..(358): a, c, t, g, unknown or other
  misc_feature (358)..(358): n is a, c, g, or t
  modified_base (504)..(504): a, c, t, g, unknown or other
  misc_feature (504)..(504): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcaggtcggggggagcgtggtccagccgtgggacgtccctgagactctcctgtgcagcctgtggtcttcattcttcagtacgactaataaaatgcacgtcgggtcccnccaggcctaccgaggcgaaggggcgtgggaggtggggtcgacgtactttattcaagtagtaggaagtacgggaaagaacagtaactacgtcganacgtacgtcgtaggacggccagccacacgtctaccgaagacgaaactacttaccgaaaagtaccgtacggttactcgtccgtagaacgtaaaggtacgtaaacgtacgtccgtaggaaacgtcggtaacggaacggacgtaccggnttagtacgttacgttacgtggtacgcggtaagggagggttcggggtttacaccggttacgcccgggtttccgggaccccgggggtaccgtacccggtaaggtttaccggaacgtaacggttaccaacgtttaaccgtacccgtaacgtttaaaacccggtttaccgggg

SEQ ID NO: 332902 - DNA, 625 bp, Homo sapiens
  misc_feature: GZ8MTXP02I034K.3.75.G09.1.454.CMB.2.raw
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
  modified_base (407)..(407): a, c, t, g, unknown or other
  misc_feature (407)..(407): n is a, c, g, or t
tcagagacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcgaggtcgggggggaggcggtggtccgagccgtgggaggtccctgacgactctcctgtgcacgcctctggtcttcacttcttcagtagactaataaatgcacgtcggcccncgaggctccgaggcgaagggcgtggagtgggngctattattnatntgatagggaagaanagtatactacgcacgtactccgtaggaacggcacgtaccactactcgacaagacgaactaataccgaaagacctacggtntacctacgtacgacgaaagttagaacgtaccgacgtaggaacgacgtagaaccggaccacgggtcgttagttacgtagtttaacggtggtagaccggtaagggtaggttaccggggtttcgacgtacggtcccggtaccggggtccgggtcccgggtaaccctaggttaaccgaaacgtacgtacggtaaccttagaccctaacgttacgttaccggg

SEQ ID NO: 332903 - DNA, 509 bp, Homo sapiens
  misc_feature: GZ8MTXP01EUM17.15.59.F04.1.454.CMB.2.raw
tcagtctacgtagccacgaccggtgctcgatttagtacacacacttagggattgggaagcctgagaacacttagccttcatgagtgtcccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactacccagctggtaccaacagaccccaggccagcctccacgcacgctcatctatagcacaaacactcgctcttctggggtccctgactcgcttctctggctccaatccctggaaacaaagctgccctcaccatcacggggcccaggcagatgatgaatctgttattattgtgtcctatatatggtgctggtctagttcggtcttcggcggagggaccaagctgaccgttcttaggtcagcccaaggcttgccccttcggtcc

SEQ ID NO: 332904 - DNA, 524 bp, Homo sapiens
  misc_feature: GZ8MTXP01DZSO5.15.59.F04.1.454.CMB.2.raw
  modified_base (356)..(356): a, c, t, g, unknown or other
  misc_feature (356)..(356): n is a, c, g, or t
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgactcgcttctctggctccntccttaggaaacaaagctgccctcaccatccgacgggggcccaggcagatgatgaatctagtttattattgtgtctatatagtgggtgctggtctatttcggtcttcgggcggacgggaccaagctgaccgttcttaggtcagcccaaggcttcgtccccgttggtcc

SEQ ID NO: 332905 - DNA, 514 bp, Homo sapiens
  misc_feature: GZ8MTXP01D3X8S.15.59.F04.1.454.CMB.2.raw
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
  modified_base (467)..(467): a, c, t, g, unknown or other
  misc_feature (467)..(467): n is a, c, g, or t
  modified_base (479)..(479): a, c, t, g, unknown or other
  misc_feature (479)..(479): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactacccagctgtaccaacacgaccccaggccagcctccacgcacgctcatctatagcaacaaacactcgctcttctggggtccctgatcgcttctctgctccatccttaggaaacaaagctcgccctcacccatcgacggggcccaggcagntgatgaatctagtttattattgtgtctatatagtggtnctggctagtttcgcttcggcggaggggacaagctgaccgtctagtcacgccaagctcgcccctgtcnctcttcgtcccnccttccttcgctaacgtgctgcgcggcttggaacg

SEQ ID NO: 332906 - DNA, 541 bp, Homo sapiens
  misc_feature: GZ8MTXP01CBLWV.15.59.F04.1.454.CMB.2.raw
tcagtctacgtagccacgaccggtgctcgatttagtacacacacttagggattggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagacccccaggccagcctccacgcacgctcatctatagcacaaaccactcgctctctgggtccctgactcgcttctctggctccatccttggaaacaagctgccctcaccatcgacggggccagcaggatgatgaatctgtttattattgtgtcctatataatgggttgcttggctagtttcggttctttcgggcgggtaggggaacccaaggcttcggtaacccgttccgtaacggg

SEQ ID NO: 332907 - DNA, 530 bp, Homo sapiens
  misc_feature: GZ8MTXP01EMVUH.15.59.F04.1.454.CMB.2.raw
  modified_base (358)..(358): a, c, t, g, unknown or other
  misc_feature (358)..(358): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgactcgcttctctggctccntccttggaaacaaagctgccctcaccatcgacgggggcccaggcagatgatgaatctgtttattagttgttgtcctatatatgggtgctggtctatttcggtcttcgggcgggagggaccaagctgaccgttccgttaggtcagcccaagggcttcgtcccccgttggtccc

SEQ ID NO: 332908 - DNA, 532 bp, Homo sapiens
  misc_feature: GZ8MTXP01B56L1.15.59.F04.1.454.CMB.2.raw
  modified_base (357)..(357): a, c, t, g, unknown or other
  misc_feature (357)..(357): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacacgaccccaggccagcctccacgcacgctcatctatagcacaaacactcgctcttctggggtccctgactcgcttctctggctccntccttaggaaacaaagctgccctcaccatcgacgggggcccaggcagatgatgaatcttagtttattagttgtgtcctatatagtgggtgctggtctagtttcggtcttcgggcggagggaccaagctgaccgttcttacggtcacgcccgtaaggcttcgcccccgttggtccc

SEQ ID NO: 332909 - DNA, 519 bp, Homo sapiens
  misc_feature: GZ8MTXP01C9CZU.15.59.F04.1.454.CMB.2.raw
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtccccctggagggaccgtcacactcacttgtggcttgagctctggctcggtctctactccttactaccccagctggtaccaacagaccccaggccagcctccacgcacgctcatctatagcacaaacactcgctcttctggggtccctgactcgcttctctggctccaatccttggaaacaagctgccctcaccatccgacggggcccaggcagatgatgaatctgtttattagttgtgtcctatatagtgggtgtctggtctagtttcggtcttcgggcggagggaccaagctgaccgttcttaggtcagccaggcttgccccttgtcc

SEQ ID NO: 332910 - DNA, 553 bp, Homo sapiens
  misc_feature: GZ8MTXP01EME9C.15.59.F04.1.454.CMB.2.raw
  modified_base (359)..(359): a, c, t, g, unknown or other
  misc_feature (359)..(359): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccacgcctccacgcacgctcatctatagcaacaaacactcgctcttcgtggggtccctgactcgcttctctggactccntccctaggaaacaagcctacgcccctcaccagtccggacgggggccagggcagatgatgaattcttagtttattagttgtgttccttattatagtgggtgcgtgtctagtttcggtcgttcgggacgggaggggaccaggtcgtacgttccgttccgttaggcacgcccgagccttccgtccccgttcggtccc

SEQ ID NO: 332911 - DNA, 537 bp, Homo sapiens
  misc_feature: GZ8MTXP01CVXO5.15.59.F04.1.454.CMB.2.raw
  modified_base (358)..(358): a, c, t, g, unknown or other
  misc_feature (358)..(358): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcccttactaccccagctggtaccaacacgaccccaggccagccctccacgcacgctcatctatagcacaaacactcgctcttctggggtccctgactcgcttctctggcctccntcccttagggaaacaagctcgcccctcaccatccgacgggggcccaggcagatgatgaatctgtttattagttgtgttcctatatagtgggtgctggtctagtttcggtcgttcgggcggagggaccaagtctgacccgttcagggtcacgcccaaggccttcgtcccccgttcggtcc

SEQ ID NO: 332912 - DNA, 553 bp, Homo sapiens
  misc_feature: GZ8MTXP01CUYD7.15.59.F04.1.454.CMB.2.raw
  modified_base (356)..(356): a, c, t, g, unknown or other
  misc_feature (356)..(356): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacactcgctcttctggggtccctgactcgcttctctggcctccntcccttggaaaacaaagcctcgcccctcaccatccgacgggggcccaggcagatgatgaatctagtttattagttgtgttcctatatagtgggtgcgtggtctagtttcggtcgttcgggcgggagggtaccaaggtctcggacccggttccttagggtccacgccccgaagggccttcgtcccccgttcgggtccc

SEQ ID NO: 332913 - DNA, 534 bp, Homo sapiens
  misc_feature: GZ8MTXP01CEMR1.15.59.F04.1.454.CMB.2.raw
  modified_base (363)..(363): a, c, t, g, unknown or other
  misc_feature (363)..(363): n is a, c, g, or t
  modified_base (480)..(480): a, c, t, g, unknown or other
  misc_feature (480)..(480): n is a, c, g, or t
  modified_base (529)..(529): a, c, t, g, unknown or other
  misc_feature (529)..(529): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctcttctggggtccctgatcgcttctctggctccatcccttggaaacaaagctgccctcaccccatcgacgggggcccaggcagntgatgaatctgtttattattgtgtcctatatatgggtgctggctagttcggtcttcgggcggagggggaccaaggctgaccgtcctaggtcagcccaaggcctcgccccctcggtcncgtcttcgttccccgcccttccgttcgctaacgtgaactgagcgggtcngggcg

SEQ ID NO: 332914 - DNA, 558 bp, Homo sapiens
  misc_feature: GZ8MTXP01B6OF8.15.59.F04.1.454.CMB.2.raw
  modified_base (273)..(273): a, c, t, g, unknown or other
  misc_feature (273)..(273): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctgtaccaacagaccccaggccagcctccacgcacgctcatctatagcaacaaacnctcgctcttcgtcgggtccctgactcgcttctctgctccatcctaggaaacaagctcgccctcaccccatcgacggggcccagcagntgatgaatcttgtttatattgtcgtactatatagtgggtncgtggctagtttcggtcgttcggggacgggacgggggactaagccgtcggaacccgtccgtaggtccacgcccgaaggccctccgccccgtcggtcaccgtcttccgtcccctacccttccgttcgcctaagagccgtggacggcggtcttcggaacg

SEQ ID NO: 332915 - DNA, 545 bp, Homo sapiens
  misc_feature: GZ8MTXP01CZ6XF.15.59.F04.1.454.CMB.2.raw
  modified_base (363)..(363): a, c, t, g, unknown or other
  misc_feature (363)..(363): n is a, c, g, or t
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
  modified_base (540)..(540): a, c, t, g, unknown or other
  misc_feature (540)..(540): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtccccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatcccttggaaacaaagctgccctcaccccatcgacgggggcccaggcagntgatgaaatctgtttatattgtgtctatatatgggtgctggctatttcggtcttcgggcggtagggggaccgaaagctcgaccgtccgtaaggtcacggcccaaagggcctcggccccctcggtcacttcnccgttccccncccttcccgttcgctaacgtgaacctgacgcggcgnggccg

SEQ ID NO: 332916 - DNA, 570 bp, Homo sapiens
  misc_feature: GZ8MTXP01DGA8Y.15.59.F04.1.454.CMB.2.raw
  modified_base (369)..(369): a, c, t, g, unknown or other
  misc_feature (369)..(369): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactcccttactaccccagctggtaccaacacgaccccaggccagccctccacgcacgctcatctatagcaacaaacactcgcttcttcgtcggggtccctgactcgtcttctctcggcctccntccttaggaaaaccaaagcctcgccctcaccactcgaccgggggcccaggcaagatgatgaattcttagttttatttagtttgttcgttaccttattatagttgggtgtcgtggtctagtttccggtcgttcgggcgggacgggaccaagcgtcgaccgttcgttaggtccagcccaaggcttccgtccccgttcggtccc

SEQ ID NO: 332917 - DNA, 546 bp, Homo sapiens
  misc_feature: GZ8MTXP01DWA9U.15.59.F04.1.454.CMB.2.raw
  modified_base (360)..(360): a, c, t, g, unknown or other
  misc_feature (360)..(360): n is a, c, g, or t
  modified_base (398)..(398): a, c, t, g, unknown or other
  misc_feature (398)..(398): n is a, c, g, or t
  modified_base (481)..(481): a, c, t, g, unknown or other
  misc_feature (481)..(481): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactacccagctgtaccaacacgaccccaggccagcctccacgcacgctcatctatagcacaaacactcgctcttcgtgggtccctgatcgcttctctgctccatccttaggaaacaagctcgccctcacccatcgacggggcccaggcagntgatgaatctgtttattattgtgtctatatagtgggtncgtggctagtttcggtcgttcgggcgggagggggaccaagctcgaccgtcgtagtcacgcccaaggcctccgcccctcggtcncttcttccgttccccacccttccttcgcctaacgtacgaacgtcggacgcgggtcgttgggaacg

SEQ ID NO: 332918 - DNA, 551 bp, Homo sapiens
  misc_feature: GZ8MTXP01AFZDB.15.59.F04.1.454.CMB.2.raw
  modified_base (363)..(363): a, c, t, g, unknown or other
  misc_feature (363)..(363): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggttcctgatcgcttctctggctccatccttggaaacaaagctcgccctcaccccatcgacgggggcccaggcagntgatgaatctgtttatattgtgtctatatatgggtgctgggctagtttcggtcttcgggcggagggggtaccaaggctacggaccgtccgtaggtcacgcccgtaaggcctcgccccctcggtccacgtcttcgttccccacccttcccttcgctaacgtcgaactggacggcggtcgttgggaaccg

SEQ ID NO: 332919 - DNA, 552 bp, Homo sapiens
  misc_feature: GZ8MTXP01DCBII.15.59.F04.1.454.CMB.2.raw
  modified_base (361)..(361): a, c, t, g, unknown or other
  misc_feature (361)..(361): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacacctcgctcttctcggggtccctgactcgcttctctggctccntcccttaggaaacaagctcgccctcaccatccgacgggggcccaggcagatgatgaatctgtttattagttgtgtcctatatagtgggtgctggtctagtttcgggtcttcggggcggaggggtaccaaggtcctacgacccgttcgttaagggtccacggcccaagggccttcgcccccttgggtaaccc

SEQ ID NO: 332920 - DNA, 610 bp, Homo sapiens
  misc_feature: GZ8MTXP01ARE4C.15.59.F04.1.454.CMB.2.raw
  modified_base (254)..(255): a, c, t, g, unknown or other
  misc_feature (254)..(255): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctgtgctcgtctctctcctaccaccnnctcgacancaccngcagccncacncacgcncatctatacgacaacaactactcgcttcttcggtccgggtccctgtacctccgtctttcctcgtcggtccctcctaacttcccgttaaagggaaaaccaacggtctccgcccctaccactacnccgggaccgggggcccaggacagtanagtagtagaattcgtttagtttattagttcgttcgttactagtaatggtggttgcgttggtacttcgtttcggtcggttcgggcgggttacgggaaccttaaggtccgtcgaccccgttcgttacggccgaccgaacccgaacgggtccttccccggtccccgttcgggtaacccc

SEQ ID NO: 332921 - DNA, 541 bp, Homo sapiens
  misc_feature: GZ8MTXP01AD5YK.15.59.F04.1.454.CMB.2.raw
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctgggacgggaccgtcacactcacttgtggcttgagctctggctcggtctctactccttactaccccagctcggtaccaacagaccccaggccacgcctccacgcacgctcatctatagcacaaaccnctcgctcttctcgggtccctgatcgcttctctgctccntcctagaaacaagctgccctnaccatccgacggggcccaggcaggntgatgaattctntttattattgtcgtacctatgtaatggggttntcgttgtcgtagtttcggttcgttcgggcggacggaaccagtcgttacgtccgttcgtg

SEQ ID NO: 332922 - DNA, 547 bp, Homo sapiens
  misc_feature: GZ8MTXP01EQ2N1.15.59.F04.1.454.CMB.2.raw
  modified_base (319)..(319): a, c, t, g, unknown or other
  misc_feature (319)..(319): n is a, c, g, or t
  modified_base (360)..(360): a, c, t, g, unknown or other
  misc_feature (360)..(360): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctcggtaccaacacgaccccaggccagcctccacgcacgctcatctatagcacaaacnctcgctcttcgtggggtccctgactcgcttctctggctccntcctaggaaacaagctacgccctacaccatccgacggggcccaggcagatgatgaatcttagtttattagttgttgttacctatattagtggtgtcgtgtctagtttcggtcttcgggtcggagggacgaacgtcgtcgaccgttcgttacggtcacgcccgacggccttcgtcccccgttggtccc

SEQ ID NO: 332923 - DNA, 586 bp, Homo sapiens
  misc_feature: GZ8MTXP01DP0Z1.15.59.F04.1.454.CMB.2.raw
  modified_base (364)..(364): a, c, t, g, unknown or other
  misc_feature (364)..(364): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacactcgctcttcgtcggggtccctgactcgcttctctggacctcntccttaggaaaacaagctcgccctcaccatccgacggggcccaggcagatgatgaatcttagtttattattgtgtctatatagtggtgcgtggtctagtttcggtcgttcgggcgggacgggtacccaaaggtccgtcggaacccggtttccgttaggggttccccaacggaacccccgaaacgggtcccgttcccggtccccccccgttcggggttccccg

SEQ ID NO: 332924 - DNA, 562 bp, Homo sapiens
  misc_feature: GZ8MTXP01DD5M3.15.59.F04.1.454.CMB.2.raw
  modified_base (356)..(356): a, c, t, g, unknown or other
  misc_feature (356)..(356): n is a, c, g, or t
  modified_base (446)..(446): a, c, t, g, unknown or other
  misc_feature (446)..(446): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctgctcggtctctactccttactacccagctggtaccaacacgaccccaggccagcctccacgcacgctcatctatagcaacaaacactgctcttcgtgggtccctgactcgtcttctctgcctcnctccttaggaaaacaacgctcgccctcaccatccggacggggcccaggcagatgatgattctgtttatagttgtcgtctatatagtggtnctggtctagtttccggtcgttcgggcgggaacgggtaccaaggtccgtcggaccccgttccgttaacgggtccaaacggcccctaaggccccgttccgtcccccgttcgggttccc

SEQ ID NO: 332925 - DNA, 526 bp, Homo sapiens
  misc_feature: GZ8MTXP01B6ALH.15.59.F04.1.454.CMB.2.raw
  modified_base (371)..(371): a, c, t, g, unknown or other
  misc_feature (371)..(371): n is a, c, g, or t
tcagtctacgtagccacgaccggtgctcgatttagtacacacacttagggattgggggaaaaggccctaaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacacctcgctctctggggtccctgntcgcttctctggctccatcccttggaaacaaagctgccctcaccatcgacggggcccaggcagatgatgaatctgttattattgtgtcctatatatgggtgctggctattcggttcgttcgggcggtaagggaccaagctgaccgtcgttggtcc

SEQ ID NO: 332926 - DNA, 552 bp, Homo sapiens
  misc_feature: GZ8MTXP01DXSCD.15.59.F04.1.454.CMB.2.raw
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtggtgacccaggagccatcgttctcagtcgtcccctggagggaccgtcacactcacttgtggcttgagtctctggctcggtctctactccttactaccccagctggtaccaacacgaccccaggccagccctccacgcacgctcatctanacgcacaaaccnctcgctcttcgtcggggtccctgactcgcttcnctggctcntctaggaacaagctagccctnaccagtcgaccggggccaggcagggatgatgaattctgtttattattggtnttctatntaagttgggttgcgttggcttgtttcggttcgttcgggcggagggaacctaggcttcgtaacccgttcgtaacggg

SEQ ID NO: 332927 - DNA, 532 bp, Homo sapiens
  misc_feature: GZ8MTXP01C5Z5R.15.59.F04.1.454.CMB.2.raw
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaacacgaccccaggccagcctccacgcacgctcatctatagcacaaccactcgctcttcgtgggtccctgactcgcttcnctggctcatcctaggaacaagctcgccctcaccagtcgacggggccaggcaggntgatgatcgtgtttatnttgtntcctatatgtgggttntcgttgtctagtttcggttcttcgggcggtacggcctaggcgttcgtccgttcgtaacgg

SEQ ID NO: 332928 - DNA, 518 bp, Homo sapiens
  misc_feature: GZ8MTXP01B6OC7.15.59.F04.1.454.CMB.2.raw
  modified_base (356)..(356): a, c, t, g, unknown or other
  misc_feature (356)..(356): n is a, c, g, or t
  modified_base (443)..(443): a, c, t, g, unknown or other
  misc_feature (443)..(443): n is a, c, g, or t
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaacacgaccccaggccagcctccacgcacgctcatcatagcacaaacactcgctcttctggggtcccctgactcgcttctctggctccntcccttaggaaacaagctgccctcaccatcgacggggcccaggcagatgatgaatctgtttattagttgtgtcctatatagtgggtnctggtcctatttcggtcttcgggcggagggccaagctgaccgttcagtcagcccaaggcttcgccccttcggtcc

SEQ ID NO: 332929 - DNA, 536 bp, Homo sapiens
  misc_feature: GZ8MTXP01ARPLG.15.59.F04.1.454.CMB.2.raw
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (481)..(481): a, c, t, g, unknown or other
  misc_feature (481)..(481): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctgggtccctgatcgcttctctggctccatccttaggaaacaagctcgccctcaccccatcgacgggggcccaggcagntgatgaatcttgttattattntgtctatatatgggtgcgtggctagtttcggtcgttcgggcggagggggacaaggctcgaccgtcgtaggtcacgcccaaggcctcgcccctcggtcnctcttcgtccccgcccttccgttcgctaacgtcgaactgaggcgggtcgttggcg

SEQ ID NO: 332930 - DNA, 544 bp, Homo sapiens
  misc_feature: GZ8MTXP01BGGWU.15.59.F04.1.454.CMB.2.raw
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggaggaccgtcacactcacttgtggcttgagctctggctcggtctctactccttactacccagctggtaccaacacgaccccaggccagcctccacgcacgctcatctatagcacaaacactcgctcttctggggtccctgactcgcttctctggctccntccctaggaaacaagctgccctcaccagtcggcggggcccaggcagntgatgatctagtttattgttgtgtcctatatagtcggtgcgtggtctagtttcggtcgtttcggggcggttacgggaccaaggtcctgttaccgttcgttacgtcgacgcccaaggcttccgtccccgttgggtaaccc

SEQ ID NO: 332931 - DNA, 568 bp, Homo sapiens
  misc_feature: GZ8MTXP01C4OJZ.15.59.F04.1.454.CMB.2.raw
  modified_base (389)..(389): a, c, t, g, unknown or other
  misc_feature (389)..(389): n is a, c, g, or t
  modified_base (463)..(463): a, c, t, g, unknown or other
  misc_feature (463)..(463): n is a, c, g, or t
  modified_base (481)..(481): a, c, t, g, unknown or other
  misc_feature (481)..(481): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcacactcacttgtggcttgagctctggctcggtctctactccttactaccccagctggtaccaacacgaccccaggccagccctccacgcacgctcatctatacgcaacaaaccactcgctcttcgtcgggtccctgactcgcttcnctcggctccattcctaggaaacaagctcgccctcactacgcgacggggccaggcagactggatcgaattcgttntttattattgtgtctatnttaagtgggttgtcgttggtctagttttcgggttcgttcggggaacgggacgggtaaccaaggcgttacgtcccggttcgtaacggg

SEQ ID NO: 332932 - DNA, 541 bp, Homo sapiens
  misc_feature: GZ8MTXP01CXLNX.15.59.F04.1.454.CMB.2.raw
  modified_base (369)..(369): a, c, t, g, unknown or other
  misc_feature (369)..(369): n is a, c, g, or t
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagacccccaggccagccctccacgcacgctcatctatagcacaaacactcgctcttctcggggtccctgatcgcttctctggctccatcccttaggaaacaaagctcgccctcaccccatcgacgggggcccaggacagntgatgaatctgtttattattgtgtctatatagtgggtgctggctagtttcgtcttcgggcggagggggaccaaggctggaccgtcgtaggtcacgcccaaggcctcgcccctggtcnctcttcgttccccncccttccgttcgctaacgtagctggacgcgggcttggaacg

SEQ ID NO: 332933 - DNA, 571 bp, Homo sapiens
  misc_feature: GZ8MTXP01D18IL.15.59.F04.1.454.CMB.2.raw
  modified_base (320)..(320): a, c, t, g, unknown or other
  misc_feature (320)..(320): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccacgcctccacgcacgctcatctatagcacaaacnctcgctcttcgtggggtccctgactcgtcttctctcggcctccaatcccttagggaaaaccaaacgcctacgcccctacaccagtccgacgggggcccaggcagatgatgaatcttagtttattattgttgtacctattatagtgggtgcgtggtcttatttccgggtcgttcgggcggagggacccaggcgtcgacccgttcgttacggtcacgtcccgaaggccttaccggtcccccgttcggtaaccc

SEQ ID NO: 332934 - DNA, 528 bp, Homo sapiens
  misc_feature: GZ8MTXP01AFO22.15.59.F04.1.454.CMB.2.raw
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacnctcgctcttctcggggtccctgactcgcttctctggctccntcctaggaaacaagctcgccctcaccatcgacgggggcccaggcagatgatgaatctgtttatgttgtgtcctatatagtggtgtctggtctagtttcggtcgttcgggcggttagggaccagtctgaccgttcgttaggtcacgcccgaggcttccgtccccgttcggtcc

SEQ ID NO: 332935 - DNA, 553 bp, Homo sapiens
  misc_feature: GZ8MTXP01CPIAW.15.59.F04.1.454.CMB.2.raw
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggacgggaccgtcacactcacttgtggcttgagctctggctcgatctctactccttactaccccagctcggtaccaacacgaccccaggccacgcctccacgcacgctcatcatagcaaccaaacactcgctccttctggggtccctggactcgcttcncgtgctccntccttaggaacaagctgccctcacctagcgacggggcccaggcgagntgatgatcttgtttaattnttgtgttctattaagtagttgggtgcgttggcttagtttcggttcgttcgggcgggtaacggaccgtaggccgtcggaaccgttaaccgg

SEQ ID NO: 332936 - DNA, 562 bp, Homo sapiens
  misc_feature: GZ8MTXP01AT9W6.15.59.F04.1.454.CMB.2.raw
  modified_base (361)..(361): a, c, t, g, unknown or other
  misc_feature (361)..(361): n is a, c, g, or t
  modified_base (416)..(416): a, c, t, g, unknown or other
  misc_feature (416)..(416): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtccccctggagggaccgtcacactcacttgtggcttgagctctggctcggtctctactccttactacccccagctggtaccaacagacccccaggccagccctccacgcacgctcatctatagcaacaaacactcgctcttctggggtccctgactcgcttctctgctccntcctggaaacaagcctagccctcacccatccgacgggggccccagcacgataganaggaatacttgtttatttattgtgttctacttatagtggtggtctgtgactttcggttcgttcggtgggacggggacaacggcgtcgttaccgccgttacggtaacgccgaaccgaaccggcgttccgtccccgttcccggtcccg

SEQ ID NO: 332937 - DNA, 539 bp, Homo sapiens
  misc_feature: GZ8MTXP01BHAO4.15.59.F04.1.454.CMB.2.raw
  modified_base (356)..(356): a, c, t, g, unknown or other
  misc_feature (356)..(356): n is a, c, g, or t
tcagtctacgtagccacgaccggtgctcgatttagtacacacacttagggattgggggaagcctgagaacacttagccttcatgagtgtccccaccatggcctggatgatgcttctcctccggactccttgcttatggatcaggagtggattctcagactgtggtgacccaggagccatcgttctcagtgtcccctggaggaccgtcacactcacttgtggcttgagctctggctcggtctctactccttactaccccagctggtaccaacagaccccaggccagcctccacgcacgctcatctatagcacaaacactcgctcttctggggtccctgactcgcttctctggctccntccctaggaaacaagctgccctcacccatcacgggggcccaggcagatgatgaatctgtttattagttgtgtcctattatagtgggtgctggtctagtttcggtcttcgggcgggttaggggacccaaaggtctgacccgttcttagggtccagccccaagggccttcgcccccgttggtccc

SEQ ID NO: 332938 - DNA, 557 bp, Homo sapiens
  misc_feature: GZ8MTXP01DMUXR.15.59.F04.1.454.CMB.2.raw
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacctacccagctgtaccaacacgaccccaggccagccctccacgcacgctcatctatagcaacaaacactcgctcttcgtcggggtccctgatcgcttctctggctccatccttaggaaacaaagctcgccctcaccccatcgacgggggcccaggcagaattatgtaaatcttgtttattattgtntctatatagtgggtncgtggtctagtttcggtcgttcggcgggacgggacaaggcgtcgaccgtctaggtcacgtacccaaggtcctccgccccctcggtcacttctccgttccccaccctccttcgcttacgtaacgactggacgcgggctcggcgaacgg

SEQ ID NO: 332939 - DNA, 524 bp, Homo sapiens
  misc_feature: GZ8MTXP01BPKVR.15.59.F04.1.454.CMB.2.raw
  modified_base (355)..(355): a, c, t, g, unknown or other
  misc_feature (355)..(355): n is a, c, g, or t
  modified_base (470)..(470): a, c, t, g, unknown or other
  misc_feature (470)..(470): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctgtaccaacagaccccaggccagcctccacgcacgctcatctatagcacaaacactcgctctctggggtccctgatcgcttctctgctccatcctggaaacaaagctgccctcacccatcacgggggcccaggcagntgatgaatctgtttatattgtgtctatatatgggtgctggctagtttcggtcttcgggcggagggggaccaagcctgaccgtcctaggtcacgcccaaggctcgcccctcggtcnctcttcgttcccacccttccgttcgctaacgtgaactgagcgggtcttggaacg

SEQ ID NO: 332940 - DNA, 599 bp, Homo sapiens
  misc_feature: GZ8MTXP01B1SMM.15.59.F04.1.454.CMB.2.raw
  modified_base (449)..(449): a, c, t, g, unknown or other
  misc_feature (449)..(449): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggaccgtcacactcacttgtggcttgagctctggctcggtctctactcccttactaccccagctggtacccaacacgaccccaggcccagccctccacgcaccgctcatctatacgacaaacaaacacctcgccttccttcgtcgggggtcccctgactccggctttctctgcctccaatccttaagggaaaacaacgcctcgcccctacaccacgtccgacggggcccaggcagatgatgaactnttagtttattagttgtgttacctattatagtgggtgtcgtggtcttaggtttccggtcgttcggggcggttagggaccgaagtccgtcggttacccgttccgttacgggtccacggcccgaacgggccttcccgtcccccgttcggtccc

SEQ ID NO: 332941 - DNA, 532 bp, Homo sapiens
  misc_feature: GZ8MTXP01DVBV4.15.59.F04.1.454.CMB.2.raw
  modified_base (359)..(359): a, c, t, g, unknown or other
  misc_feature (359)..(359): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (469)..(469): a, c, t, g, unknown or other
  misc_feature (469)..(469): n is a, c, g, or t
  modified_base (519)..(519): a, c, t, g, unknown or other
  misc_feature (519)..(519): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctgtaccaacagaccccaggccagcctccacgcacgctcatctatagcaacaaacactcgcttcttcgtggggtccctgactcgcttctctggcctccnttccttagggaaaaccaagctcgccctacaccatcgacggggcccaggcagangatgaatcttagtttattgttgttgttctatntagtgggtnctggtctatttcggtnttcggcggagggccaagctgacccgttcttaggtcagcccgaagccttcnccccgttggtccc

SEQ ID NO: 332942 - DNA, 617 bp, Homo sapiens
  misc_feature: GZ8MTXP01B1OZ3.15.59.F04.1.454.CMB.2.raw
  modified_base (367)..(367): a, c, t, g, unknown or other
  misc_feature (367)..(367): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacacgaccccaggccagcctccacgcacgctcatctatagcaacaaacactcgctcttcgtcgggtccctgatcgcttctctggctccatccttaggaaacaagctcgccctcaccccatcgaccgggggcccaggacagntgatgaattcttagtttattattgtgtcctatatagtgggtgcgtggtcttagtttcggtccgtttcggggacgggtaacgggggaacccgtaaggtccgtacggtacccgtcgtacggtcacggcccgaaggtcctccgcccccgttaacggtcccttaccgttcccgttcccgtttccccgccccgttcccgttccgttaccgttaacggtacgtaacgtcggacggccgggtaacgttgggaaccgg

SEQ ID NO: 332943 - DNA, 572 bp, Homo sapiens
  misc_feature: GZ8MTXP01CZ5BG.15.59.F04.1.454.CMB.2.raw
  modified_base (398)..(398): a, c, t, g, unknown or other
  misc_feature (398)..(398): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcactttgtggcttgagctctggctcggtctctactcccttactaccccagctggtaccaacacgaccccaggccagccctccacgcacgctcatctatacgacaacaaacactcgctcttcgtcggggtccctgactccgtcttctcgtggcctacaattcctaggaaaccaaagctcgcccncaccactcggaccgggggccaggcagactgatgaattcttagttttattagtttgtcgttcctattatagttgggtgtcgtggtctagtttcggtcgttcgggcgggagggaccgagccgtcgacccgttcgttacggtcacgcccgacggtcccgccgtcccccgttcgtccc

SEQ ID NO: 332944 - DNA, 543 bp, Homo sapiens
  misc_feature: GZ8MTXP01DWAPB.15.59.F04.1.454.CMB.2.raw
  modified_base (356)..(356): a, c, t, g, unknown or other
  misc_feature (356)..(356): n is a, c, g, or t
  modified_base (406)..(406): a, c, t, g, unknown or other
  misc_feature (406)..(406): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttacacccagctggtaccaacacgaccccaggccagcctccacgcacgctcatctatagcacaaacactcgctcttctggggtccctgactcgcttctctgcctccntcctggaaaacaagctcgccctcaccagtccgacgggggccagggcaggntgatgaatctgtttattagttgtgttcctatatagtggtgcgtggtcttagtttcggtcgttcgggcgggacgggaccaaggctcgaaccgttcttacgggtcaacgtcccaaggccttccgtcccccgttggtccc

SEQ ID NO: 332945 - DNA, 679 bp, Homo sapiens
  misc_feature: GZ8MTXP01EANRE.15.59.F04.1.454.CMB.2.raw
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (421)..(421): a, c, t, g, unknown or other
  misc_feature (421)..(421): n is a, c, g, or t
  modified_base (604)..(604): a, c, t, g, unknown or other
  misc_feature (604)..(604): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggctttgagtctcgtggctcggtctctactccttacctacccngctcgaaccaacaccgaccccaggccacgccctccgacgcacgctcatctanacncaaacaaacnctcgcttcgttcggtcgggtcctgactccgtctttctcgtcggtcctcctagtttacccgttaaaggaaaactaacgtccttccgacccctacaaccccgacgtaccgggacccgggggcccagggaaccaaggtntagtaatacgtaactttcgtttagttttaattttagtttcgtacgtttacttaagttagttaggttggggttcgtcgttgggtctttacggtttccggtcggttacggggacgggtaacggggaactaagtccgtacggtaccgtcgtagtccgacgaccgtagtcctcccgcccgtcgtccnccgttccttccgtcccctcccgttccgttcttaccgtaacgtacgtccgtgggacgttcgggtcgttcgggaacg

SEQ ID NO: 332946 - DNA, 516 bp, Homo sapiens
  misc_feature: GZ8MTXP01C6MFH.15.59.F04.1.454.CMB.2.raw
  modified_base (357)..(357): a, c, t, g, unknown or other
  misc_feature (357)..(357): n is a, c, g, or t
  modified_base (440)..(440): a, c, t, g, unknown or other
  misc_feature (440)..(440): n is a, c, g, or t
  modified_base (453)..(453): a, c, t, g, unknown or other
  misc_feature (453)..(453): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtccccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccntccttggaaacaaagctgccctcaccatcacgggggcccaggcagatgatgaatctgttattattgtgtcctatatatgggtnctgtctattcgtnttcgggcggaggggccaagtctgaccgttccttaggtcagcccaggcttgcccccttggtccc

SEQ ID NO: 332947 - DNA, 539 bp, Homo sapiens
  misc_feature: GZ8MTXP01BAUOK.15.59.F04.1.454.CMB.2.raw
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccttcacactcacttgtggcttgagctctggctcggtctctactccttactaccccagctggtaccaacagaccccaggccagcctccacgcacgctcatctatagcacaaacactcgctcttctgggtccctgatcgcttctctggctccatccttaggaaacaagctgccctcaccccatcgacgggggcccaggcagntgatgaatctgttattattgtgtctatatagtgggtntctggctagttcggtcttcgggcggagggggacaaggtctacggaccgtcgtaggtcagccctaaggcctcgcccctcggtcactccttcgttcccgcccttccgttcgcctaacgtgaactcggacgcgggcttggaacg

SEQ ID NO: 332948 - DNA, 678 bp, Homo sapiens
  misc_feature: GZ8MTXP01DW26R.15.59.F04.1.454.CMB.2.raw
  modified_base (379)..(379): a, c, t, g, unknown or other
  misc_feature (379)..(379): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactcccttactaccccagctggtaaccaacacgaccccaggccacgccctccaccgcacgctcatctatacgacaacaaacacctcgcttcgttcgtcggggtcccctgacctcgtcttctctcggcctaccncttccttagggaaaacctaacggtcctacgccccttaccacccgtacgtccggacccggggggccccaggggccaaggtagttagaagtaggtaaacttcgtttagtttttatttaagtttcgttacgtttaccttaagttagttaggttggggttctcgttgggtacttcgtttttccggggtcgtttcgggggacgggttaggggtaacccttaaggtccgtacggttaacccggttccgttacgggtccctacgaaccccggacggtcccttccggtcccccgttcgggtttcccc

SEQ ID NO: 332949 - DNA, 566 bp, Homo sapiens
  misc_feature: GZ8MTXP01EL6X8.15.59.F04.1.454.CMB.2.raw
  modified_base (364)..(364): a, c, t, g, unknown or other
  misc_feature (364)..(364): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcccttacaccccagctggtaccaacacgaccccaggccagcctccacgcacgctcatctatagcaacaaacactcgctcttcgtcggggtcccctgactccgctttctctcggcctcccnttcccttagggaaaaccaagccttacgccccctacacccagtccgaccgggggccccagggcagatgatgaatcttagtttattagttgttgtcctatatagtgggtgcgtggtctagttcggtcgttcgggcggttagggacccaagctcggacccgttcgttacggtcacgcccgaaggccttcgtcccccgttggtccc

SEQ ID NO: 332950 - DNA, 582 bp, Homo sapiens
  misc_feature: GZ8MTXP01ENKFH.15.59.F04.1.454.CMB.2.raw
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacaccccagctggtaccaacacgaccccaggccagccctccacgcacgctcatctatagcaacaaacacctcgctcttcgtcggggtcccctgactcgcttctctcggcctccaattcccgttaagggaaaaccaaagcctcgcccctacaccagtccgacgggggcccagggcaagactgatagaattcttagtttattagttgttacgttaccttaattagttagtgggttgtccgtgggtcttagtttccggtcgttcgggcggttagggacccaagtcgtacgaccgttcttaggtcacgtccagggccttccgtccccgttggtaaccc

SEQ ID NO: 332951 - DNA, 565 bp, Homo sapiens
  misc_feature: GZ8MTXP01CFA25.15.59.F04.1.454.CMB.2.raw
  modified_base (365)..(365): a, c, t, g, unknown or other
  misc_feature (365)..(365): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcacaaacactcgcttcttcgtcggggtccctgactcgcttctctggacctccntcccttaggaaaacctaaagcctcgcccctacaccacgtccgacgggggcccagggcagaatgatgaatcttgtttattattgtgttcctatatagtgggtgctggtctagttcggtgtttccgggcgggagggtacccaagcgtcgaccgttccttacggtccacggcccgaacggccttccgtccccgttcggtaacc

SEQ ID NO: 332952 - DNA, 555 bp, Homo sapiens
  misc_feature: GZ8MTXP01CWOV6.15.59.F04.1.454.CMB.2.raw
  modified_base (260)..(260): a, c, t, g, unknown or other
  misc_feature (260)..(260): n is a, c, g, or t
  modified_base (364)..(364): a, c, t, g, unknown or other
  misc_feature (364)..(364): n is a, c, g, or t
  modified_base (469)..(469): a, c, t, g, unknown or other
  misc_feature (469)..(469): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccngctggtaccaacacgacccaggccagcctccacgcacgctcatctatagacacaaacactcgctcttcgtcggggtccctggactcgtcttctctgccttcccntcccttaagggaaaacctaaacgctcgcccctacaccacgtcgaccgggggcccaggccagatgatgaaatctagtttattagttgtgttcctatatagtgggtncgtgtctagttccggtcgttcgggacggagggtaccagctcgaccgttcttacggtcacgcccaggccttccgccccgttcggtcc

SEQ ID NO: 332953 - DNA, 587 bp, Homo sapiens
  misc_feature: GZ8MTXP01D0BHB.15.59.F04.1.454.CMB.2.raw
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcccttactacccagctggtaaccaacacgaccccaggccacgccctccacgcacgctcatctatagcaacaaacnctcgcttcttcgtggggtccctgactcgcttctctgcctccntccttaggaaaacaacgctcgccctcaccatcgaccgggggcccaggcaggatgatgaaatcttagtttatttagttgttgttaccttagtatagttgggtcgtctggtcttagtttccgggtcgtttcggggcggggagggtacccaaggtccgtcggttaccccggttcgttaacggtccaacggccccgaagggtccttccggtccccccttgtcccgg

SEQ ID NO: 332954 - DNA, 620 bp, Homo sapiens
  misc_feature: GZ8MTXP01CHZOB.15.59.F04.1.454.CMB.2.raw
  modified_base (364)..(364): a, c, t, g, unknown or other
  misc_feature (364)..(364): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgacccccaggccagccctccacgcacgctcatctatagcaacaaacactcgctcttctcggggtccctgactcgcttctctggcctccntccttaggaaacaagcctcgcccctcacccagtccggaccgggggcccaggcagatgatgtaatctgtttattagttgtcgttacctattagtagttgggtgtcgtggtcctagttttcccgggtacgtttcgggggcgggaacggggtaacccgaaggtcccgttacgggaaccccggtttccgttaacgggttccctaccgggtaaccccgaacgggtcccgttcccggtcccccccgttcgggtttaaccccg

SEQ ID NO: 332955 - DNA, 680 bp, Homo sapiens
  misc_feature: GZ8MTXP01A32TR.15.59.F04.1.454.CMB.2.raw
  modified_base (258)..(258): a, c, t, g, unknown or other
  misc_feature (258)..(258): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctggacgggaccgtcacactcacttgtggcttgagctctggctcggtctctactccttactacccngctggaccaacacgaccccaggccagcctccacgcacgctcatctatagcaacaaacactcgctcttcgtcgggtcctgacctcgtcttctcgtcgtacctccaacttaccgttaacgggaaaacctaacgtccgtcgacccctaccacctacgtaccgggacccgggggcccagggaccaggtactagattacgtaactttcggtttattttaagtttaggtttggttacgttaccttaagttagttaggttgggtcgtccggttggtaccgtttacggttttccgggtccgggttcgggggtaccggggttaacggaacccgttacggttaccgtaccgggttaccccgttcggttacggtaacccggacggaaccccgaacgggtccccgttcccggtaacccccggttcggttccccg

SEQ ID NO: 332956 - DNA, 528 bp, Homo sapiens
  misc_feature: GZ8MTXP01BFLVT.15.59.F04.1.454.CMB.2.raw
  modified_base (362)..(363): a, c, t, g, unknown or other
  misc_feature (362)..(363): n is a, c, g, or t
  modified_base (479)..(479): a, c, t, g, unknown or other
  misc_feature (479)..(479): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatcccttggaaacaaagctgccctcaccccatcgacgggggcccaggcagnngatgaatctgtttattattgtgtcctatatagttgggtgcgtggctagtttcggtcttcgggcggagggggaccaaggctgaccgtctaggtcagcccaaggctcgcccctggtcnctcttcgtcccgcccttccgcgctaacgtgaactgagcggtcgttggcg

SEQ ID NO: 332957 - DNA, 548 bp, Homo sapiens
  misc_feature: GZ8MTXP01CYOAW.15.59.F04.1.454.CMB.2.raw
  modified_base (361)..(361): a, c, t, g, unknown or other
  misc_feature (361)..(361): n is a, c, g, or t
  modified_base (450)..(450): a, c, t, g, unknown or other
  misc_feature (450)..(450): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaacacgaccccaggccagccctccacgcacgctcatcatagcacaaacactcgctcttctgggggtccctgactcgtcttctctggcctccntcctaggaaacaagctacgccctcaccatccgacgggggcccaggcagatgatgaatcttgtttattagttgtgtcctatatagtggtncgtgtctagtttcggtcgtttcggcggagggaccaaggctgacccgttccgttagggtcacggcccgaaggccgttccgtcccccgttcggtaacccc

SEQ ID NO: 332958 - DNA, 521 bp, Homo sapiens
  misc_feature: GZ8MTXP01BGBWI.15.59.F04.1.454.CMB.2.raw
  modified_base (356)..(356): a, c, t, g, unknown or other
  misc_feature (356)..(356): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacactcgctcttctggggtccctgactcgcttctctgctcntcctaggaaacaagctcgcctcaccatcgacggggccaggcagatgatgatctgttattagtgtgtcctatatagtggtgcgtggtctagtttccgggtcgttcgggcgggagggaccaagctcgaccgttcaggtcagcccgaggccttcgccccgttggtccc

SEQ ID NO: 332959 - DNA, 586 bp, Homo sapiens
  misc_feature: GZ8MTXP01BK0K1.15.59.F04.1.454.CMB.2.raw
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctgtaccaacacgaccccaggccagcctccacgcacgctcatctatagcaacaaacactcgctcttctcggggtccctgatcgcttctctggctcatccttgaaacaagctgccctcacccatcgacggggcccaggcagntgatgaatctntttattattgtgtctatatagtgggtgcgttggctagtttccggtcgttcgggccgggacgggggtaccaaggtccgtacggacccgtaccgtacggtcgaccgacccgtaacggccctccggcccccgtcggtaccttaccgttccttccgttcccctacccttcccgttccgttcctaacgtacgaacgtcggacggcgggtcgttcggaaccgg

SEQ ID NO: 332960 - DNA, 529 bp, Homo sapiens
  misc_feature: GZ8MTXP01B3RF5.15.59.F04.1.454.CMB.2.raw
  modified_base (357)..(357): a, c, t, g, unknown or other
  misc_feature (357)..(357): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcaacaaacactcgctcttcgtggggtccctgactcgcttctctggctccntccttaggaaacaagctacgcccctcaccatccgacggggcccaggcagatgatgaatcttagtttattagttgttgtcctatatagtgggtgcgtggtctagtttcggtgttcgggcggagggaccagcgtgaccgttcttaggtcacgccgaggcttcgccccgttgtcc

SEQ ID NO: 332961 - DNA, 618 bp, Homo sapiens
  misc_feature: GZ8MTXP01CIBKN.15.59.F04.1.454.CMB.2.raw
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
  modified_base (528)..(528): a, c, t, g, unknown or other
  misc_feature (528)..(528): n is a, c, g, or t
  modified_base (553)..(553): a, c, t, g, unknown or other
  misc_feature (553)..(553): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagacccccaggccagccctccacgcaccgctcatctatagcaacaaacactcgctcttctcggggtcccctgatcgctttctctggctccatcctttaggaaaccaaagctacgccctcaccccatcgacgggggcccaggcagntgatgaatctgtttatattgtgttcctatagtatgggtncgtaggctagtttcggtctttcggggacggacggggggaccaaggtccgtcgtaacccgttccgtaaggttccaacgccccgaaacggtcccgtaccggtcccccctcgggttcnccctttccgttcggtttaacccccnccccttccgttccgttaccgttaaccgtcgtaaccgttcggacggccgggccgttcgggaaccgg

SEQ ID NO: 332962 - DNA, 552 bp, Homo sapiens
  misc_feature: GZ8MTXP01CPVYA.15.59.F04.1.454.CMB.2.raw
  modified_base (359)..(359): a, c, t, g, unknown or other
  misc_feature (359)..(359): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtccccctggagggaccgtcacactcacttgtggcttgagctctggctcggtctctactccttactacccagctggtaccaacacgaccccaggccagcctccacgcacgctcatctatagcacaaacactcgctcttctcggggtcctgactcgcttctctggctccnttcctagggaaacaagcctcgccctcaccatccgacggggccaggcagatgatgatctgtttattagttgtgtacctatatagtgggtgtctggtctagtttcggtcgttcgggcggttagggaccaagtcgtcgttacccgttccgttacggtccacggcccgaaggtccttccgtccccgttccggttccc

SEQ ID NO: 332963 - DNA, 531 bp, Homo sapiens
  misc_feature: GZ8MTXP01AD65I.15.59.F04.1.454.CMB.2.raw
  modified_base (362)..(362): a, c, t, g, unknown or other
  misc_feature (362)..(362): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
  modified_base (526)..(526): a, c, t, g, unknown or other
  misc_feature (526)..(526): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtcccctgatcgcttctctggctccatcccttggaaacaaagctgccctcacccatcacgggggcccaggcagntgatgaatctgtttatattgtgtcctatatatgggtgctggcatttcggtcttcggcggacgggggaccaagctacgaccgtcctaggtcagccccaagggcctcgccccctcggcacgtcngttccccacccgttccncgctaacgtnaacctgcgcgggtcngggcc

SEQ ID NO: 332964 - DNA, 569 bp, Homo sapiens
  misc_feature: GZ8MTXP01CT3F1.15.59.F04.1.454.CMB.2.raw
  modified_base (391)..(391): a, c, t, g, unknown or other
  misc_feature (391)..(391): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctgggacgggaccgtcacactcacttgtggcttgagctctggctcggtctctactccttacaccccagctcggtaccaacacgacccccaggcccacgccctccacgcacgctcactctatacgcacaaaccactcgctctcgtcggggtccctgactcgcttcncgtcgctccatcctaggaaacaagctcgccctcacacgcgacggggccaggcaggatgatgaattctagttttattattgtcttactatgtaagtgggttgtcgttggtcttacgtttcggttcgttacggggcggtacgggtaaccaaggtcgttacgtaacccgttccgtaacggg

SEQ ID NO: 332965 - DNA, 542 bp, Homo sapiens
  misc_feature: GZ8MTXP01C4R9R.15.59.F04.1.454.CMB.2.raw
  modified_base (366)..(366): a, c, t, g, unknown or other
  misc_feature (366)..(366): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtccccctggagggaccgtcacactcacttgtggcttgagctctggctcggtctctactccttactaccccagctggtaccaacacgaccccaggccagcctccacgcacgctcatctatagcaacaaacacttcgcttcttcgtcggggtccctggactcgcttctctggctccntccttaggaaaacaagctcgcccctcaccagtccgacgggggcccaggcaagatgatgaaatctagtttattattgtgttacctatattatcggggtncgtgtnttagttcggtcgtcgggcggaggacagtcgtcgaccgttcttacgcacgccgagccttccgtccccgttgtc

SEQ ID NO: 332966 - DNA, 562 bp, Homo sapiens
  misc_feature: GZ8MTXP01CC2LU.15.59.F04.1.454.CMB.2.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcctactaccccngctggtaccaacncgaccccaggccagccctccacgcacgctcatctatagcaacaaacccactcgctctcgtcggggtccctgactcgtcttctctcggctcctactccgttagaaacaaacgctcgaccctcaccagtccgacggggccaggcaggatgatagtaatcttagtttattattgtcgttctatataagtgggttgcgttgtctagtttcggttcgttcgggcgggacgggaaccgagcgttacgtaacccgttcgtaacgg

SEQ ID NO: 332967 - DNA, 562 bp, Homo sapiens
  misc_feature: GZ8MTXP01ENLKQ.15.59.F04.1.454.CMB.2.raw
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccccagctcggtaccaacagacccccaggccagcctccacgcacgctcatctatagcacaaaaccactcgctctccgtggggtcccctggatccgcttctcttggctccatcccttggaaacaaagctcaccctcaccgatcgaccggggccacgggacagggtatgatcgaatactgtttattattgttntntatatgtggttgtgttgtcgtcgttcggttcggttcgggtcgggtacgggaacgacggacgttacgtccggttccgtaacg

SEQ ID NO: 332968 - DNA, 566 bp, Homo sapiens
  misc_feature: GZ8MTXP01BGDW0.15.59.F04.1.454.CMB.2.raw
  modified_base (367)..(368): a, c, t, g, unknown or other
  misc_feature (367)..(368): n is a, c, g, or t
  modified_base (388)..(388): a, c, t, g, unknown or other
  misc_feature (388)..(388): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcacaaacactcgctcttcgtcggggtcccctgatcgcttctctggctccatccttaggaaacaagctcgccctcaccccatcgacggggcccaggcagnngatgattctgttattatgtntactatatagtggtgctgctagttcgtcgttcgggcgggacggggacaagtccgtcggaccgtcgtaggtccacggccctaaggcctccgccccctaaggtccactccgttccgttccccacccgttccgttcgttccgtaacgttagaaccgtggacggccgggtcgttcggaaccg

SEQ ID NO: 332969 - DNA, 764 bp, Homo sapiens
  misc_feature: GZ8MTXP01CBFRK.15.59.F04.1.454.CMB.2.raw
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccagggacgccattcgttctcagtccgtccccgtgggacgggaccgtcacactctactttggtggtcttggagtccttcgtggtccgttccggtccttaccttaccttcccttaaccctaccccagtcgttacggaacccaaacgaccgacccacggcccaacgccctaccaccgccaccgcctacacttactaatacgaccaaaccaaaacctcctccggtcctttccgtttcggtcggggtcccctgtaccctccgtcttctccgtcggtcccttacctaacgttaccgttaaacgggaaaaaccaaacgtcctaccgtaccccctaccaacctacgtacccggggacccgggggacccagggtacaaagtataggaatagtaacttgtttagttttaatttaggttggtttacttacttaattagttaggtcggggttctcggttgtaccgtttacggttttccggtcgggtaaccgggggacgggttaacggaaaccttacggtccgttccgggttaccccgttcggttaccggtaaccgaacccggtaacccgtacggtccccgttaccccggtcccccgttcgtaaccc

SEQ ID NO: 332970 - DNA, 577 bp, Homo sapiens
  misc_feature: GZ8MTXP01AE7RO.15.59.F04.1.454.CMB.2.raw
  modified_base (322)..(322): a, c, t, g, unknown or other
  misc_feature (322)..(322): n is a, c, g, or t
  modified_base (428)..(428): a, c, t, g, unknown or other
  misc_feature (428)..(428): n is a, c, g, or t
  modified_base (469)..(469): a, c, t, g, unknown or other
  misc_feature (469)..(469): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggaccgtcacactcacttgtggcttgagctctggctcggtctctactccttactaccccagctggtaccaacacgaccccaggccagcctccacgcacgctcatctatagacacaaacnctcgctcttcgtggggtccctgactcgtcttctcgtggcctcctcttcccgtaagggaaacaaacgcctacgcccctacaccatccggaccgggggcccaggcagntgatgaatcttgtttattagttgtgtcctatagtgtgggtntcgtggtcttacgtttcggtcgtttcgggcgggacgggacgaagcgtacggcccgttcgttacggtccaacggtcccgaggtccttccggtcccccgttggtaacccc

SEQ ID NO: 332971 - DNA, 595 bp, Homo sapiens
  misc_feature: GZ8MTXP01BUTN5.15.59.F04.1.454.CMB.2.raw
  modified_base (326)..(326): a, c, t, g, unknown or other
  misc_feature (326)..(326): n is a, c, g, or t
  modified_base (479)..(479): a, c, t, g, unknown or other
  misc_feature (479)..(479): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacctcacactcacttgtggcttgagctctggctcggtctctactcccttactaccccagctcggtaccaacacgaccccaggccacgccctccacgcacgctcatctatacgcaacaaacnctcgcttcttcgtggggtcccctgacctcgctttctctcggcctccaattcccttaagggaaaaccaagcctcgcccctacaccatccggaccgggggcccaggctagatgatgatcttagtttattacgttgtgttcctatatgtggggttncgtgtcttacgtttccggtcggttcgggcgggacggaccacggtccgtacggttacccgttcgacggtaaccgaccggaacccgacggtccccttacccgtcccccgttcggtccc

SEQ ID NO: 332972 - DNA, 567 bp, Homo sapiens
  misc_feature: GZ8MTXP01ELH7X.15.59.F04.1.454.CMB.2.raw
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
  modified_base (417)..(417): a, c, t, g, unknown or other
  misc_feature (417)..(417): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaacacgaccccaggccagccctccacgcacgctcatctatagcaacaaacnctcgctcttcgtggggtcccctgactcgcttctctcggcctccntcccttagggaaacaaagctcgccctcaccatccgaccgggggcccaggcagntgatgaatctagtttatagttgtgtacctatatagtgggtgctggtactgtttccgggtcgttcgggcgggttagggacccaaagtccgtaggacccgttccgttacgggtccacggccccgaacgggtccttccgtcccccttcgttcg

SEQ ID NO: 332973 - DNA, 586 bp, Homo sapiens
  misc_feature: GZ8MTXP01BTCI5.15.59.F04.1.454.CMB.2.raw
  modified_base (463)..(463): a, c, t, g, unknown or other
  misc_feature (463)..(463): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactggtggtgacccaggagccatcgttctcagtcgtccccgtggacgggacctcacactcacttgtggcttgagctctggctcggtctctactccttacacccagctgaccacacgacccagccacgcctccacgcacgctcatctatacgacaacaaacactcgctcttcgtcggggtccctgtactcgtcttctcgtcggcctcctaatccgttaagggaaaaccaaacgtcctaccgcccctacaccacgtccggaccgggggcccagggcaagatgatagtatcttagtttattagttgtnttacctattatgtgggtgtcgtggtctagtttccggtcgttcggggcggaggaccaggtcgtcgttaccgttcgttacggtaacacggaacccacgggccttcccgtccccgttcggtaaccc

SEQ ID NO: 332974 - DNA, 620 bp, Homo sapiens
  misc_feature: GZ8MTXP01CP5MR.15.59.F04.1.454.CMB.2.raw
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (566)..(566): a, c, t, g, unknown or other
  misc_feature (566)..(566): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactacccagctggtaccaacacgaccccaggccagcctccacgcacgctcatctatagcaacaaacnctcgctcttctgggtccctgatcgcttcnctcgtctctactcgtaagaaactacgctcgccctacaccccgtagaccgggaccggggacccaggaacaagctagtaatagtacttctttagtttattacttgttcttacctattagtaggttgggtgtcgtgtcgttacgtttcgtacggttcggggacggaacggggtacgaaacgttcgaccggtccgtacggtacgtcgaccgtaccggaccgtctccccggtcccggttcgtaccttcttccgttcccgttccccncccttccgttccgccgttaacggcgttaacgacggcgggcggtcgcggaaccgg

SEQ ID NO: 332975 - DNA, 581 bp, Homo sapiens
  misc_feature: GZ8MTXP01BEPYI.15.59.F04.1.454.CMB.2.raw
  modified_base (352)..(352): a, c, t, g, unknown or other
  misc_feature (352)..(352): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (502)..(502): a, c, t, g, unknown or other
  misc_feature (502)..(502): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcacactcacttgtggcttgagctctggctcggtctcactccttactacccagctggtaccaacacgaccccaggccagcctccacgcacgctcatctatagcacaaaccnctcgctccttcgtcggggtccctgactccgtcttctctggctccatccttaggaaacaacgctcgacccctacaccacgtccgaccgggggccccagggtccaggggatgatgtaatcttgtttattattgtntactattntaagtgggntcgttgtacttgtttcgggttccgttcggggcgggtacgggaacccgtaaggtccgttacggtcccgttccgtaacggg

SEQ ID NO: 332976 - DNA, 589 bp, Homo sapiens
  misc_feature: GZ8MTXP01COOZD.15.59.F04.1.454.CMB.2.raw
  modified_base (372)..(372): a, c, t, g, unknown or other
  misc_feature (372)..(372): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctacttcccttaccaccccagctacggtaccaacacgaccccaggccacgcctccacgcacgctcatctatacgacaacaaactactcgcttcttcgtcggggtccctgacctccgcttctctcggactccntccctagaaacaacgctcgccctcaccatccggaccggggccaggcagatagatgaattcttagttttattaggtttgttagttacctaatagttagtcggttgcgttggtcttacgtttcggtcgttaacggggacggacgggtaacaggtacctcggaccgttccgttacgggtccacggcccgaacgggccttacccggtcccccgttggtccc

SEQ ID NO: 332977 - DNA, 759 bp, Homo sapiens
  misc_feature: GZ8MTXP01EZ7BQ.15.59.F04.1.454.CMB.2.raw
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccgtggaggaccgtcacactcacttgtggcttgagtctctggctcggtctctactccttacacccagctggtaccaacacgaccccaggccagccctcacgcacgtctcactctatacgacaacaaacacctcgtcttcgttcgtacggggtccctggacctcgtcttctcgtcggtaaccctcctaacttacccgtttaaagggaaaaccctaacggtccttacggcccctaccgaaccgaacgtcccgggaaccggggggccccaaggggaccttaaagggacgttacggggaaacttacgggtaaatttccttttaagggtttttaaatttaagggttttcggtttacggttaaccctttaaattaggtttaacgggtcgggggtttgccgggtttggggtaccttaacgggttttttccggggtccgtttaacggggggacggttaaacgggggaccccttaaagggtcccgttaacgaacccgggtttccgttaacggggttccaaaccgggtccccgttaacgggggcccttcccgggtcccccccggtttgggttaaccccc

SEQ ID NO: 332978 - DNA, 560 bp, Homo sapiens
  misc_feature: GZ8MTXP01EJ2FW.15.59.F04.1.454.CMB.2.raw
  modified_base (323)..(323): a, c, t, g, unknown or other
  misc_feature (323)..(323): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
tcagtctacgtagccacgaccggtgctcgatttagtacacacacttagggagttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttacaccccagctggtaccaacacgaccccaggccagccctccacgcacgctcatctatacgcaacaaacncctcgctctttcgtggggtcccctgtactcgtcttctctggaacctccaagtcctagggaaacaagcctcgcccctcaccatccggacgggggccaggctagatgatnaacttnttattattgtcgttntctatatgtggtgtgtgtgtcgttcgttcggtcggcgggacggacgacgtcgtcgttaccgttccgttacggtcgacgccgacgccgttcccgtccccgttccgtccg

SEQ ID NO: 332979 - DNA, 562 bp, Homo sapiens
  misc_feature: GZ8MTXP01AEU5Q.15.59.F04.1.454.CMB.2.raw
  modified_base (362)..(362): a, c, t, g, unknown or other
  misc_feature (362)..(362): n is a, c, g, or t
  modified_base (492)..(492): a, c, t, g, unknown or other
  misc_feature (492)..(492): n is a, c, g, or t
tcagtctacgtagccacgaccggtgctcgatttagtacacacacttagggattggggggaagcctgagaacacttagccttcatgagtgtcccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacacgaccccaggccagccctccacgcacgctcatctatagcaacaaacactcgctcttcgtggggtcccctgactcgcttctctcggctcccntcccttaggaaacaaacgctgcccctacacccatcggaccgggggcccagggcaggatgatagaacttctagttttattagttgtgttccttaatatagtggtgtcgtgtcgttattcgggtcttcgggnggacggacgttaagcgtcgacccggttccaggtccaggccccgaaggccgttccgtcccccgttggtccc

SEQ ID NO: 332980 - DNA, 560 bp, Homo sapiens
  misc_feature: GZ8MTXP01DZ3ZB.15.59.F04.1.454.CMB.2.raw
  modified_base (503)..(503): a, c, t, g, unknown or other
  misc_feature (503)..(503): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactcccttactaccccagctggtaccaacacgaccccaggcccagccctccacgcacgctcatctatagacacaaaccactcgcctcttccgtcggggtcccctggatccgcttctctggctccactccttaggaaacaacgctcgcccctcaccactccgaaccgggggcccaggcacggggatcgatgaatcttagtttattattgtgtacctatataatgggttntcgttgctgtttcggttcttcgggcggagggaaccagcttcgcccgttcgtaacggg

SEQ ID NO: 332981 - DNA, 533 bp, Homo sapiens
  misc_feature: GZ8MTXP01DP484.15.59.F04.1.454.CMB.2.raw
  modified_base (341)..(341): a, c, t, g, unknown or other
  misc_feature (341)..(341): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
  modified_base (503)..(503): a, c, t, g, unknown or other
  misc_feature (503)..(503): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctcggtaccaacagaccccaggccagccctccacgcacgctcatcgtanagcacaaacactcgctcttcgtcggggtccctgactccgtcttctctggctccatccttaggaaacaagctagccctcacatccgacggggcccaggcaggatgaatgaatcttgtttatattntgtctatntaatggttncttgctagttcggnttcgggngagggccaagcgttgtaaccgttctaacgg

SEQ ID NO: 332982 - DNA, 629 bp, Homo sapiens
  misc_feature: GZ8MTXP01ET4EC.15.59.F04.1.454.CMB.2.raw
  modified_base (366)..(366): a, c, t, g, unknown or other
  misc_feature (366)..(366): n is a, c, g, or t
tcagtctacgtagccacgaccggtgctcgatttagtacacacacttagggattggggggaaaaggccctgaggaaaacaaaccccagctgggaagcctgagaacacttagccttcatgagtgtccccaccatggcctggatgatgcttctcctcggactccttgcttatggatcaggagtggattctcagactggtggtgacccaggagccatcgttctcagtcgtcccctgggacgggacctcacactcacttggtggcttgagctcgtggctcggtctctacctccttacctaccccagcgtacgtaccaacacgaccccaggccacgccctccacgcacgctcatctatacgacaacaaaccncctcgctcttcgtcgggtccctgactccgtcttctcgtcggctcctattccgttaacggaaacaacgtcctcgcccctacaccgtacgtccggaccgggggcccagggcaggatagatagtaattcgttagtttaattgttacgtcgttaccttaagttagttaaggtcgggttgtcgttcggtacgttcggttttcggttcgttaccggggaacgggtacggtaacctaaggtccttaccggggtaacccgttcgtaaccgg

SEQ ID NO: 332983 - DNA, 547 bp, Homo sapiens
  misc_feature: GZ8MTXP01BT2RD.15.59.F04.1.454.CMB.2.raw
  modified_base (353)..(353): a, c, t, g, unknown or other
  misc_feature (353)..(353): n is a, c, g, or t
  modified_base (469)..(469): a, c, t, g, unknown or other
  misc_feature (469)..(469): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctgggacggaccgtcacactcacttgtggcttgagctctggctcggtctctactccttactaccccagctggtaccaacacgaccccaggccagccctccacgcacgctcatctatagcacaaaccnctcgctcttctcggggtccctgatcgcttctctgctccatcctagaaacaagctgccctcacactcgacggggccagcaggactggatgtaatcttgtttattattgtgtcctatntaagtgggttgtcgttggctagtttcgggttcttcgggcggtagggaaccaaggcgttcgtaacccgttcgtaacggg

SEQ ID NO: 332984 - DNA, 634 bp, Homo sapiens
  misc_feature: GZ8MTXP01DNHQV.15.59.F04.1.454.CMB.2.raw
  modified_base (284)..(284): a, c, t, g, unknown or other
  misc_feature (284)..(284): n is a, c, g, or t
  modified_base (378)..(378): a, c, t, g, unknown or other
  misc_feature (378)..(378): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggaccgtcacactcacttgtggcttgagctctggctcggtctctactccttacctacccagctggtaccaacacgaccccnggcccacgccctccacgcacgctcatctatacgacaacaaacacctcgcttcttccgtcggggtccctgacctcgtcttctcgtcggcctaccnttaccgttagggaaaaccaacgcctcgacccctacaccagtccggaccgggggcccagggcagatgatacgtattcttagttttattagttgtcgttacttaagttagtagttgggtcgtccgttggtcttacgtttcgggtccgttcgggggcggttaacggggaccaacggtccgtcggacccggtttccgttacgggttccgaaccggtcccgtaacgggtcccttcccggtcccccgttaacgggttccccg

SEQ ID NO: 332985 - DNA, 759 bp, Homo sapiens
  misc_feature: GZ8MTXP01CRH8W.15.59.F04.1.454.CMB.2.raw
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtgggacgggaccgtcacactcacttgtggcttgagctctggctcggtctctactccttactacccagctcgtaccaacacgaccccaggccacgcctcacgcacgctcatctatacgacaacaaacactcgcttcttcgtcggggtccctgtacctcgtcttctctaggtcctaccctaacttcccgtttaagggaaaaaactaaacgcctccgacccccttacaaccctaacgtacccgggaacccggggggcccaacgggtaccgaagtaagtaggtaagttagtaaatttctttaaggtttttaaactttacggttttaggtttacggtttaacccttaagtttaaagttaagttcgggggttagtccggtttagggtcctttaacgtttttcccgggggtccggttttaaccgggggtcgggggaaacgggggtaaacccaaacgggtcccgtttaacgggttaaccccggtttccgttaacggggttaacccaaacgggttccccgaaaacggggtcccttaccccggtcccccccgtttaacgggtttaaccccc

SEQ ID NO: 332986 - DNA, 565 bp, Homo sapiens
  misc_feature: GZ8MTXP01CSIFH.15.59.F04.1.454.CMB.2.raw
  modified_base (408)..(408): a, c, t, g, unknown or other
  misc_feature (408)..(408): n is a, c, g, or t
  modified_base (516)..(516): a, c, t, g, unknown or other
  misc_feature (516)..(516): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttactacccagctggtaccaacacgaccccaggccacgccctccacgcacgctcatctatagcacaaacactcgctcttctcggggtcccctgatcgctttctctggctccatccttaggaaacaagctcgccctcaccccatcgacgggggcccaggcagaatgatgaatctgtttattattgtgtctatatagtgggtntcgtgctagtttcggtcgttcgggcggagggggacctaaggccgtacgccgttccgtaggtcacgcccgtaaggcctcgccccctggtccacttccttccgttccccnccttcccgttcgcctaacgtacgaacgtggacggccggcgttggaaccg

SEQ ID NO: 332987 - DNA, 566 bp, Homo sapiens
  misc_feature: GZ8MTXP01BACPT.15.59.F04.1.454.CMB.2.raw
  modified_base (430)..(430): a, c, t, g, unknown or other
  misc_feature (430)..(430): n is a, c, g, or t
tcagtctacgtagccacgaccggtgctcgatttagtacacacacttagggattggggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtccccgtgggacgggaccgtcacactcacttgtggcttgagtctctggctcggtctctactccttactaccccagctcggtaccaacacgaccccaggccagcctccacgcacgctcatctatagcacaaaccactcgctcttcgtcggggtccctgactcgcttctctcgctcacttcttaggaaacaagcctcgcccctcaccncgtcggacggggcccaggcaggactgatgtaattcttagtttattattgtcgttctatatcgtgggttatcgttggtacttgtttcggttcgttcgggcgggaggtaaccaggtcgttacgtccgttcgtaacggg

SEQ ID NO: 332988 - DNA, 616 bp, Homo sapiens
  misc_feature: GZ8MTXP01DT9X3.15.59.F04.1.454.CMB.2.raw
  modified_base (378)..(378): a, c, t, g, unknown or other
  misc_feature (378)..(378): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggaccgtcacactcacttgtggcttgagctctggctcggtctctactcccttacaccccagctggtaacccaacacgacccccaggccagccctccacgccacgctcatctatacgacaacaaacacctcgcttctttccgtcggggtcccctgactccgtctttctctcggccctccnttccgttaggaaaaaccaacgcctcgcccctacacccatccggacgggggcccaggcaagatgatgtaaattctttagtttatttagtttgttcgttacctattatagtgggttgtcgttggtcttagtttccggttcgtttcggggcgggacgggaccgttaaagtccgtacggttaccccgttcgttaacggtcacggcccgaacggccttcccgtcccccgttcggttaaccccg

SEQ ID NO: 332989 - DNA, 586 bp, Homo sapiens
  misc_feature: GZ8MTXP01BE2RR.15.59.F04.1.454.CMB.2.raw
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttacacccagctggaccaacacgaccccaggccagcctccacgcacgctcatctancgacaacaacnctcgctcttcgtcgggtccctgactccgtcttctctcggcctaccnttcccgttaagggaaaaccaacggtcctcggccccttacaccctacgtccggaccgggggcccaggccgagatgatagtattcttagtttattagttgttcgttccttatagtagtggtgtcgtgtcttagtttcggtcgttcgggcggacgggaccagtccgtcggacccgttccgttacggtccgaccgtcccgacggtcccttccgtccccgttcggtaaccc

SEQ ID NO: 332990 - DNA, 593 bp, Homo sapiens
  misc_feature: GZ8MTXP01A6FXY.15.59.F04.1.454.CMB.2.raw
  modified_base (282)..(282): a, c, t, g, unknown or other
  misc_feature (282)..(282): n is a, c, g, or t
  modified_base (383)..(383): a, c, t, g, unknown or other
  misc_feature (383)..(383): n is a, c, g, or t
  modified_base (488)..(488): a, c, t, g, unknown or other
  misc_feature (488)..(488): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagtctcgtggctcggtctctaccttccttacctaccccagctacggtaccaacncgaccccaggccagccctccacgcacgctacatctatacgcaacaaacacctcgcttcgttcgtcggggtccctgacctcgtctttctcgtcggcctaccnttacctagggaaaaccagcctcgacccctcaccagtccggacggggcccaggcagatgatgatcttagtttacttaggttgtcgttacctagttagtagtgggtntccgtagtccgtagtttcggtcgttcgggcggttacggggacacgtcgtcgaccgttcgacggtccacgccgacgggtccttacccgtccccgttaacggtcccc

SEQ ID NO: 332991 - DNA, 558 bp, Homo sapiens
  misc_feature: GZ8MTXP01D6CRF.15.59.F04.1.454.CMB.2.raw
  modified_base (278)..(278): a, c, t, g, unknown or other
  misc_feature (278)..(278): n is a, c, g, or t
  modified_base (367)..(367): a, c, t, g, unknown or other
  misc_feature (367)..(367): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactaccccagctggtaccaacacgaccccaggccagccctccacgcacgctcatctatagcaacaaacnctcgctcttctcggggtccctgatcgcttctctggctccatcccttaggaaacaagctcgccctcacccatcgacgggggccaggcagntgatgaatctgtttattattgtgtctatatagtggtagcgttggctagttcggtcttcgggcggtacgggggacaaggtctacgaccgtccgtacggtcacgccgaaggtcctccgcccctcggtccttactccgttcgtccccaccttccgcgttactaacgtacgaactggacgcggtcgttggaaccg

SEQ ID NO: 332992 - DNA, 592 bp, Homo sapiens
  misc_feature: GZ8MTXP01CGWJ8.15.59.F04.1.454.CMB.2.raw
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccctggagggaccgtcacactcacttgtggcttgagctctggctcggtctctactccttactacccagctcgtaccaacacgaccccaggccacgcctccacgcacgctcatctatagcaacaaacactcgctcttcgtcggggtccctgactcgcttctctcggtcctcctaacttcccgttaagggaaaaccaaacggtcctacgcccctaccacccacgtccggaccgggggcccaagggcaaggataggtatagtaacttcttagtttattagtttgtcgttactatattagtgggtgtcgtggtcttagtttcggtcgtcgggacgggttaggaccgagcgtcgacccgttcgttacggtcgacgtccgacggccttccgtccccgttcggtcc

SEQ ID NO: 332993 - DNA, 605 bp, Homo sapiens
  misc_feature: GZ8MTXP01EUKE5.15.59.F04.1.454.CMB.2.raw
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttacctaccccagctggtaccaacacgaccccaggccagccctccacgcacgctcatctanacgacaacaaacnctcgtcttcttcgtcggggtccctgacctcgtcttctcgtggccctcctaactccttaaggaaacaacgcttcgcccctacaccagtccggaccgggggcccagggacaagattagatagaacttcttagtttacttagttgttcgttactagtntagtgggtncgtggtcttagtttcggtcgttcgggacggttacgggaccaaaggtcctacgggacccgttccgttacggccacggtccctaacgggcccttacccgtcccccgttaacggtcccc

SEQ ID NO: 332994 - DNA, 547 bp, Homo sapiens
  misc_feature: GZ8MTXP01CGG0J.15.59.F04.1.454.CMB.2.raw
  modified_base (358)..(358): a, c, t, g, unknown or other
  misc_feature (358)..(358): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacacccagctggtaccaacagaccccaggccagcctccacgcacgctcatctatagcacaaacactcgctcttcgtggggtccctgactcgcttctctggcctccntccctagggaaacaagctacgccctcaccatcgacgggggcccaggcagatgatgatctgtttattagttgtgtcctatatatggtagctggtctagtttcggtcgttcgggcggttaggggacccaaagcgtcggttacccgttcttacgggtcacgcccgaagggccttcgtcccccgttcggtccc

SEQ ID NO: 332995 - DNA, 584 bp, Homo sapiens
  misc_feature: GZ8MTXP01C22DG.15.59.F04.1.454.CMB.2.raw
  modified_base (293)..(293): a, c, t, g, unknown or other
  misc_feature (293)..(293): n is a, c, g, or t
  modified_base (449)..(449): a, c, t, g, unknown or other
  misc_feature (449)..(449): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtgtgacccaggagccatcgttctcagtcgtcccctggacggaccgtcacactcacttgtggcttgagctctggctcggtctctactccttactaccccngctcgtaccaacacgaccccagccagccctaccacgcacgctcactctatacgcaacaaaccactcgctcttcgtcgggtccctgactcgtcttctctcgctccattacctaggaaacaagcctcgccctacaccagcgaccggggccaggcaggntgatacgtaattcttagtttattagtttgtacgttctattagtaagttgggttacgtcgttggtcgttagttttcgggttcgtttacggggcgggtacgggaaccaaggccttacggtaacccgttcgtaacggg

SEQ ID NO: 332996 - DNA, 569 bp, Homo sapiens
  misc_feature: GZ8MTXP01E082G.15.59.F04.1.454.CMB.2.raw
  modified_base (364)..(364): a, c, t, g, unknown or other
  misc_feature (364)..(364): n is a, c, g, or t
  modified_base (434)..(434): a, c, t, g, unknown or other
  misc_feature (434)..(434): n is a, c, g, or t
  modified_base (474)..(474): a, c, t, g, unknown or other
  misc_feature (474)..(474): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacaccccagctgtaccaacacgaccccaggccagcctccacgcacgctcatctatagacaacaaacactcgtctcttcgtcggggtccctgacctcgcttctctcggctccntaccctaagggaaacaaagtcctcgccctcaccagtccggacgggggcccaggcaagatgatagtaactnttagttaatttagttcgttgttactatagttagtggggtncgtgtctacgttcgggtcgttcggggacgggacggacgacgtcgtcgttaccgttcgttacgcacgaaccgacggccttccgtccccgttcgtcc

SEQ ID NO: 332997 - DNA, 697 bp, Homo sapiens
  misc_feature: GZ8MTXP01A1DIK.15.59.F04.1.454.CMB.2.raw
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcttacctacccagctggtaccaacacgaccccaggccacgcctccacgcacgctcatctatacgcacaaacactcgctcttcgtcggggtccctgactcgtcttctctcggtccctcctctccgtttacgggaaaactaaacgtcctcgacccctaccaccctacgtcccggaacccggggggcccaacggggccaaacggtagtacggtaaacgttaggaaactttcgtttagttttaacgtttaaggtttcggtttacgttaaccctttaagttaagttaacggttggggttcgtcggtttcggtccgtttaacgttttcccggggttccgtttcgggggacggggttaccggggtaaaccgttacggtacccgtcggttaaccccggttcgttaacgggtccacgggccccgaacggtccgttacccggtcccccttcgggttaaccccg

SEQ ID NO: 332998 - DNA, 554 bp, Homo sapiens
  misc_feature: GZ8MTXP01DE9HT.15.59.F04.1.454.CMB.2.raw
  modified_base (362)..(362): a, c, t, g, unknown or other
  misc_feature (362)..(362): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacactcgctcttcgtcggggtccctggactcgcttctctggcctccnttccttagggaaaacaaagcctgcccctcaccatcgaccgggggcccaggcagatgatgaatcttagtttattagttgtgttctatatagtggtgctgtctatttcggtcttcgggcggagggtaccaaggtctcgttaccgttccgttaggtccacgtcccgaaggccttccgtcccccgttcggttcccc

SEQ ID NO: 332999 - DNA, 645 bp, Homo sapiens
  misc_feature: GZ8MTXP01ES3BS.15.59.F04.1.454.CMB.2.raw
  modified_base (262)..(262): a, c, t, g, unknown or other
  misc_feature (262)..(262): n is a, c, g, or t
tcagtctacgtagccacgaccggtgctcgatttagtacacacacttagggattggggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggaccgtcacactcacttgtgcttgagctctgctcggtctctactccttactacccanctggtaccaacacgaccccaggccacgccctccacgcacgctacactctatagactaacaaacctacctcgtcttcgtttcgtcgggggtaccctgacctcgtctttctcctggccctcaacttccgtaggaaacaagtcctcgccctacaccacgtccggaccgggggcccagggaccagagtagattagaaacttcttaggtttaatttaggtttgttacgttacctaagttaagttggtgggttcgtccgttagggtcttcggttttccgggtcggtttaacggggcgggttaacgggaccgttaagccggttacgaacccgttcgttacggtaaccacgaacccgtaacggcccttcccggtccccgttcggttccccg

SEQ ID NO: 333000 - DNA, 767 bp, Homo sapiens
  misc_feature: GZ8MTXP01AWCBX.15.59.F04.1.454.CMB.2.raw
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactggtggtgacccaggagccatcgttctcagtcgtcccctgggacgggaccgtcacactcacttgtggcttgagtctcgtgctcggtctctactccttacacccagctcggtaccaacacgaccccgaggccacgcctccacgccacgctcactctatacgacaacaaacacctcgtacttcttcgtcggggtccctgactcgtcttctcgtcggtcctcctaacttccgttaaacgggaaaacctaaacgtccgttaccgaccccttacccacccgtacgtacccgggacccggggggacccagggaccaaggtagtgtaacgtacgttaaactttcgttagtttttaagtttagtttcggttacggtttacctttaaagttacgtttaagggtcgggggtttctacccgggttgggtaaaccgtttcggtttttcccgggggttccgggtttccgggggaacgggggaaaccggggggttaaacccaaacggggttcccggttaacggggttaccccggttttaccgggaaccgggttaacccgaacccgggttaacccggaaccggggttccccgttaccccggtcccccgggttcggtttaacccccg

SEQ ID NO: 333001 - DNA, 585 bp, Homo sapiens
  misc_feature: GZ8MTXP01D3TQV.15.59.F04.1.454.CMB.2.raw
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcaccgctcatctatagcacaaacactcgctcttcgtcggggtcccctgatcgcttctctcggctccatccttaggaaacaaagctcgccctcaccccactcgaccgggggcccaggcagntgatagatcttgttattattgtntctatatagtggtntcgtggtctagttcggtcgttcgggacggagggggaacctaaggtcctcggtaccgtccgtaggtccgaacgcccgtaacggccgtccgcccccgtcggtccactcccgttccgtccccgtcccttccgttccgttccgtaaccgtagtcgtggacggccggtcgttcggaaccgg

SEQ ID NO: 333002 - DNA, 572 bp, Homo sapiens
  misc_feature: GZ8MTXP01A3WFF.15.59.F04.1.454.CMB.2.raw
  modified_base (410)..(410): a, c, t, g, unknown or other
  misc_feature (410)..(410): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacacgaccccaggccagccctccacgcacgctcatctatagcacaaacactcgctcttcgtcggggtccctgatcgcttctctggctccatcccttaggaaacaagcctgccctcacccactcgaccgggggcccaggcagctgaatgaattcttagtttattattgtgtctatatagtgggtncgtagtctagtttcggtcgttcgggcggacgggggacgaagcgtacggacccgttcgtagggtccacggccctaacgggcctccggcccctggtcccttactcccttcgtcccctacccttccgttcgcgtaacgagccgtgacggcgggtcgttcggaacg

SEQ ID NO: 333003 - DNA, 534 bp, Homo sapiens
  misc_feature: GZ8MTXP01EVL06.15.59.F04.1.454.CMB.2.raw
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacactcgctcttcnggggtccctgactcgtctctctggctcntcctagaaacaagctagccctcacatcacggggcccaggcagatgatgatctagtttatagttgtgtacctatatatggtgctggtctatttcggtcttcgggcggttaggggaccaagggctcggacccgttcttacgggttccagcccgaacgggcttcggcccccttggtcccc

SEQ ID NO: 333004 - DNA, 622 bp, Homo sapiens
  misc_feature: GZ8MTXP01A4QDG.15.59.F04.1.454.CMB.2.raw
  modified_base (409)..(409): a, c, t, g, unknown or other
  misc_feature (409)..(409): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagacccccaggccagacctccacgcacgctcatctatagcacaaacactcgctcttcgtgggtcccctgatcgcttctctggctccatccttaggaaacaagctgccctcaccccatcgacgggggcccaggaccagaatgatgaatcttgtttattattcgtgtcctatatagtgggtncgtggctagtttcggtcttcgggcggagggggaccaaggctacggacccgttccgtaaggtccaacggccccgaaagggtccctccggtcccccccgtaacgggtcccttaccgttcccgttccgttccccccgtaaccccttcccgttccgttacccgttaacccgggtaacggtaaccgttacgggacggccggggtcgttcgggaaccgg

SEQ ID NO: 333005 - DNA, 661 bp, Homo sapiens
  misc_feature: GZ8MTXP01E2MMQ.15.59.F04.1.454.CMB.2.raw
  modified_base (232)..(232): a, c, t, g, unknown or other
  misc_feature (232)..(232): n is a, c, g, or t
  modified_base (329)..(329): a, c, t, g, unknown or other
  misc_feature (329)..(329): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctntggctcggtctctactcccttactaccccagctggtaacccaacacgaccccaggcccacgccctccacgccacgctcatctatacgacaacaaacnctcgcttcttcgtcggggtccctgactccgcttctcgtcgcctacctcttacccgttaagggaaaaacctaaacggtccttccggacccccttaccaacccgtacgtacccgggacccggggggaccccaacgggccaaggatgaatagtaattcttagttttattagtttgtagtttacctagtattagtgggttcgtcgtggtcttaggtttccggttcggttccggggacgggttacgggacccgttaacgccgtcggttacccgttccgttacgggtccacggccccgaagggtccccgttcccggtccccccgttcggttaaccccg

SEQ ID NO: 333006 - DNA, 599 bp, Homo sapiens
  misc_feature: GZ8MTXP01DZ8GT.15.59.F04.1.454.CMB.2.raw
  modified_base (306)..(306): a, c, t, g, unknown or other
  misc_feature (306)..(306): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgtttatggatcaggagtggattctcagactgtggtgacccaggagccatcgttctcagtcgtcccctggaggaccgtcacactcacttgtggcttgagctctggctcggtctctactccttacctacccagctcggtacaacacgaccccaggccagccctccacgcacgctcatctanacgacaacaaacactcgctcttcgtcgggtccctgactccgtcttctcgtcgcctaccattcccgttagggaaaacctaaaggcctccgccctacaccacgtccggacggggcccaggcagatgatacgattcttagtttattgttgggtnttactattagtagttggngtcgtcggtcttagtttcggtcgttggggcggtaacgggcctaaacgttcgtacggtaccggttccgttagggaccaacgcccgaacggtcccgtacccggccccgttaacggttcctaacccg

SEQ ID NO: 333007 - DNA, 577 bp, Homo sapiens
  misc_feature: GZ8MTXP01BG3CJ.15.59.F04.1.454.CMB.2.raw
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggacgggaccgtcacactcacttgtggcttgagctctggctcggtctctactccttacctaccccagctggtacccaacacgaccccaggccagccctccacgcacgctcatctatagcaacaaaccactcgctcttcgtcggggtccctgatccgtcttctctggctccatccttaggaacaagctcgccctcacacgcgaccggggcccaggcaggactgatcgtaatcttgtttattattgttgtaccttatataagtgggttgcgttgggcttagtttccgggttcgttcgggaacgggtagggaacccgaagggtccgttacggtaacccgttcgtaaccggg

SEQ ID NO: 333008 - DNA, 558 bp, Homo sapiens
  misc_feature: GZ8MTXP01DQD2F.15.59.F04.1.454.CMB.2.raw
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
  modified_base (460)..(460): a, c, t, g, unknown or other
  misc_feature (460)..(460): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttacacccagctggtaccaacacgaccccaggccagcctccacgcacgctcatctatagcaacaaacnctcgcttcttcgtcggggtccctgtactcgtcttctctggcctccntcctaggaaaacaagctcgccctcaccatccggaccgggggcccaggcaagatgatgaatcttagtttattagttgtgttactattatgtgggtntcgtggtcttaggtttcggtcgttcgggcgggagggacccaaggtctggacccgttcgttaggtcaacgcccgaagccttccgtccccgttcggtccc

SEQ ID NO: 333009 - DNA, 553 bp, Homo sapiens
  misc_feature: GZ8MTXP01BLRN4.15.59.F04.1.454.CMB.2.raw
  modified_base (368)..(368): a, c, t, g, unknown or other
  misc_feature (368)..(368): n is a, c, g, or t
  modified_base (472)..(472): a, c, t, g, unknown or other
  misc_feature (472)..(472): n is a, c, g, or t
  modified_base (494)..(494): a, c, t, g, unknown or other
  misc_feature (494)..(494): n is a, c, g, or t
  modified_base (536)..(536): a, c, t, g, unknown or other
  misc_feature (536)..(536): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttacctacccagctggtaccaacacgaccccaggccagccctccacgcacgctcatctatacgacaacaaacacctcgctcttcgtcggggtccctgacctcgcttctctggccctccnttccctaggaaactaacgctcgccctacaccagtccggacgggggccaggcaagatgatgaattcttagtttacttagttgttcgtactattagtattgggctntggtctgtttcggtcgttcggnggacgggcaagcgtgacccgttcacggtcacgccgaggtccncgtcccccgttggtccc

SEQ ID NO: 333010 - DNA, 656 bp, Homo sapiens
  misc_feature: GZ8MTXP01BGXKP.15.59.F04.1.454.CMB.2.raw
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctggaggacctcacactcacttgtggcttgagctctggctcggtctctactccttactacccagctgtaccaacacgacccaggccagcctcacgcacgctcatctatagcaacaaacactcgtctcttcgtcggggtccctgactcgtcttctcgtcggtaaccttcccaattcccgttaagggaaaaccaaacggtccctcgaccccttacaaccctacgtccggaacccggggggccccaggggaccaggtaatggaactagaaactttcgtttagtttatttacggtttgttacgttacttaattagtggttgggtcgtcgttcggtcgttacggtttccgggtcggttcggggacggggttacgggaaccgttacggtccgtaaccgttcccggttacggttacggtaaccgaccggtaacccgtaacggtcccgttaccccgtccccgttccggtccc

SEQ ID NO: 333011 - DNA, 592 bp, Homo sapiens
  misc_feature: GZ8MTXP01DG32K.15.59.F04.1.454.CMB.2.raw
  modified_base (318)..(318): a, c, t, g, unknown or other
  misc_feature (318)..(318): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcaacactcacttgtggcttgagtctctggctcggtctctactccttactaccccagctggtaccaacagacccccnggccagccctccacgcacgctcatctanagcacaaacnctcgctctcgtcggggtccctgactcgtccttctctggactccatcctaggaaacaacgctcgaccctcaccacgtcgaccggggcccagggccaggactgaactgaattcgttagttttatttagtttgtgttaccttattaagtgttggggttcgtcgttggtcttaggtttcgggttcgttacggggcgggtacgggaaccgaaggtccgttacggtaaccgttcgtaacggg

SEQ ID NO: 333012 - DNA, 622 bp, Homo sapiens
  misc_feature: GZ8MTXP01EMZ8Q.15.59.F04.1.454.CMB.2.raw
  modified_base (277)..(277): a, c, t, g, unknown or other
  misc_feature (277)..(277): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactaccccagctgtaccaacacgaccccaggccacgcctccacgcacgctcatctatagcaacaaacnctcgctcttcgtcgggtccctgactcgtcttctcgtgctccattcccgttaaggaaaacaacgtctcgccctacacccacgtcggaccgggggcccaggacaaggtntgaattagtaaattcgttagttttattattcgtnttacctatattagtgggtctcgtggtctagtttcggtcgttcggggacgggtaacgggggaacaaaggtccgtacgtcccgtcgtacggcaaccgacccgtaggtccctccgccccgtcgtccttaccttccgttccgttcccccaccttcccgttcgttaccgttaacgtacgtaacgtggacggcgggtccgttgggaaccg

SEQ ID NO: 333013 - DNA, 801 bp, Homo sapiens
  misc_feature: GZ8MTXP01B5HVH.15.59.F04.1.454.CMB.2.raw
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggaggacctcacactcacttgtgcttgagctctggctcgtctctactccttactacccagctggtaccaacacgaccccagccacgcctccacgcacgctcatctatacgacaacaaacactcgcttcttcgtcggggtccctgactccggtctttcgtctacggcctaccctaacttacccgttaagggaaaaaccctaaacgtcctaccggtaccccctaccgaacccctacggtaccccgggaacccgggggggacccctaacggggacccgaaacgggtaagttaccggtaaagttacggttaaatttaccgttttaaggttttttaaatttttaaccgggtttggttttaccgggtttacccctttaaaggtttaacgttacgggtttgggggtacggttccggttaacgggttcctttaccgggtttttccggggttccggtttaacccgggggaacgggggttaacggggaaaccccgttaaagggtcccgttaccgggttaaccccggtttccggttaaccggggttccaacccgggtaaccccggtaaacgggtccccgttaccccggtccccccgtttcggggttaacccccg

SEQ ID NO: 333014 - DNA, 574 bp, Homo sapiens
  misc_feature: GZ8MTXP01CYFSI.15.59.F04.1.454.CMB.2.raw
  modified_base (183)..(183): a, c, t, g, unknown or other
  misc_feature (183)..(183): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctnagtcgtccccgtggacgggaccgtcacactcacttgtgcttgagctctggctcggtctctactccttactacccagctcggtaccaacacgaccccaggccagcctccacgcacgctcatctatacgcaacaaacactccgcttcttcgtcggggtccctgactcgcttcnctgacctcnctctaggaaacaacgctcgccctcacctagtccgaccgggggcccacggcagtatacgatgaaattcttagtttactttagttgttcgttacctaatagtagtcgggtgtcgtgtcgtagtttcggtcgtcgggtcgggacggtacgacgtcgtcgttacccgttcgacggtcaccggtcccgaggtccttcccgtccccgttcggtcccg

SEQ ID NO: 333015 - DNA, 540 bp, Homo sapiens
  misc_feature: GZ8MTXP01EWBYA.15.59.F04.1.454.CMB.2.raw
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
tcagtctacgtagccacgaccggtgctcgatttagtacacacacttggggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacctaccccagctggtaccaacacgaccccaggccagccctccacgccacgctcatctatagcaacaaacccactcgctcttcgtcggggtccctgactcgcttctctgctcntctagaacaagcngccctcaccatcgacggggccaggcaggatgatgaatcttgtttattattgtgtctatataagtgggttgcttggctagtttcggttcttcgggcgggaggaacctaaggcgttacgtccgttcgtaacgg

SEQ ID NO: 333016 - DNA, 560 bp, Homo sapiens
  misc_feature: GZ8MTXP01A52YL.15.59.F04.1.454.CMB.2.raw
  modified_base (358)..(358): a, c, t, g, unknown or other
  misc_feature (358)..(358): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtgcttgagctctggctcggtctctactccttactacccagctcgaccaacacgacccagccacgcctccacgcacgctcatctatagacaacaaacactcgctcttcgtcggggtccctgactcgtcttcgtctggcctccntcctaggaaacaagctcgccctcacacgtcgacggggccaggcagatgatagaattcttagtttattagttgttgtacttatagtagtgggtgtcgtgtacctgtttcggcgttcgggcggttacgggaccaagtccgtcgacccggttccttagggtccaccggcccgtaaggcccttccggtcccccgttcgggtaaccc

SEQ ID NO: 333017 - DNA, 622 bp, Homo sapiens
  misc_feature: GZ8MTXP01E4Z4F.15.59.F04.1.454.CMB.2.raw
  modified_base (185)..(185): a, c, t, g, unknown or other
  misc_feature (185)..(185): n is a, c, g, or t
  modified_base (518)..(518): a, c, t, g, unknown or other
  misc_feature (518)..(518): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtcccctggaggaccgtcacactcacttgtggcttganctctggctcggtctctactccttactacccagctggtaccaacacgaccccaggccacgcctccacgcacgctcatctatagacaacaaacactcgcttcgtcgtcgggtccctgactcgtcttctcgtcgctccactaccgtaagaaacaacgctccgccctcaaccccacgtacggaccggggcccaggaacaagcgtagatagtaatctttagtttattagttgtacgtactatagtagtgggtgcgtggtctagtttcgggtcgttcgggacggaacgggggaacaacgcgtcgtacccgttccgacgtaccaaccgcccgaacgtccncccgtcccccgtcggtaccttaccttccgttccccgtttccccgcccttcccgttcgttacccgtaacggtataacccgtgggacgcgggtcgttcgggaaccg

SEQ ID NO: 333018 - DNA, 719 bp, Homo sapiens
  misc_feature: GZ8MTXP01ACL9X.15.59.F04.1.454.CMB.2.raw
  modified_base (327)..(327): a, c, t, g, unknown or other
  misc_feature (327)..(327): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggacgggaccgtcacactcacttgtggcttgagctctggctcggtctctactccttactaccccagctcggtaccaacacgaccccaggccacgccctccacgcacgctcatctatacgacaacaaacnctcgcttcttcgtcggggtccctgtactccgtctttcctctcggtcctcctaacttcccgttaagggaaaaccaaaggtcccttacgcccccttacaacccgtacgtcccgggaacccggggggccccaaggggacccaaagggtacttaggaacgttagtaactttaccgttttagttttaatttaacggtttggttacgttaccttaagttacgttaggtcgggttgtccgttaggtcgtttcggttttccgggtcggtttaaccgggggacgggaaccgggttaaaccgacggtaccgtaccgggttaccccggttccgttaaaccgggtccgtaacccggaacccggaacccgggtcccgttaccccgtcccccggttcggttccccc

SEQ ID NO: 333019 - DNA, 695 bp, Homo sapiens
  misc_feature: GZ8MTXP01B82KJ.15.59.F04.1.454.CMB.2.raw
  modified_base (266)..(266): a, c, t, g, unknown or other
  misc_feature (266)..(266): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
tcagtctacgtagccacgaccggtgctcgatttagtacacacacttagggattggggggggaagcctgagaacacttagccttcatgagtgtccccaccatggcctggatgatgcttctcctcggactccttgcttatggatcaggagtggattctcagactggtggtcgacccaggacgccattcgttctcagtcgtccccgtggacgggaccgtcacactcacttggtggcttgagtctcgtggctcggtctctactccttacncccagctacggaccaacacgaccccaggccacgcctccacgctacgctacatcatacncaacaaacnctcgctcttcgtcgggtcctgacctcgtcttctcgtgaccttccaatcctaagggaaacaacgtctccgaccctacaccacgtacccggaccgggggaccacggacgagacgttaggaattacggtaactttacgttttagttttaattttaggtttcgtttacgttaccttaagttaagttaggttcggggtcgtcgggttcgtaaccgtttacggttttccgggttccggttcgggggtaaccggggacgggtaacccgagggttaccgttcggttaccccggttcggttaacgggtcccggaccgtaacccggtaaccgggtcccgttaccccggtcccccggttaacggtttcccccg

SEQ ID NO: 333020 - DNA, 681 bp, Homo sapiens
  misc_feature: GZ8MTXP01B9ZD2.15.59.F04.1.454.CMB.2.raw
  modified_base (261)..(261): a, c, t, g, unknown or other
  misc_feature (261)..(261): n is a, c, g, or t
  modified_base (320)..(320): a, c, t, g, unknown or other
  misc_feature (320)..(320): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggacggaccgtcacactcacttgtggcttgagctctggctcggtctctactccttacacccngctggtaccacacgacccaggccagccctccacgcacgctcatctatacgacacaaacnctcgcttcgttcgtcgggtccctgtacctcggtctttacgtccgtggtacccttaccctaagtcccgttaaaggaaaaccgtaacgtccttaccgaccccttacaacccgtacgtacccgggacccgggggaccccagggccgaagataggtaacttcgttaaattcgtttagttttaacgtttaggtttcggttcgttaacctagtttagtaggttcggttgtccggttgtacgttcggttttccggtacggttccgggaacggttaacggaccttaacggtccgtcggttaccccgttcgttacgttccaccggtcccttaacggtccgttaccccgtccccgttaacggttaaccccg

SEQ ID NO: 333021 - DNA, 570 bp, Homo sapiens
  misc_feature: GZ8MTXP01CQC09.15.59.F04.1.454.CMB.2.raw
  modified_base (369)..(369): a, c, t, g, unknown or other
  misc_feature (369)..(369): n is a, c, g, or t
  modified_base (459)..(459): a, c, t, g, unknown or other
  misc_feature (459)..(459): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagacaacaaactactcgcttcttcgtcggggtcccctgacctcgtcttctctggcctccntccttaggaaaacaaacgctcgccctcaccatcgacggggcccagcagatgatgaatctagtttatagttgttgtcctatatagtgggtnagtgtctagtttcggtcgttcgggcggagggtacccaaggtccgtcggttaccccgttcgttacggtccacgcccgaagggccttacccggtcccccgttaacgggtcccc

SEQ ID NO: 333022 - DNA, 600 bp, Homo sapiens
  misc_feature: GZ8MTXP01CLT5J.15.59.F04.1.454.CMB.2.raw
  modified_base (326)..(326): a, c, t, g, unknown or other
  misc_feature (326)..(326): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtccccgtgggacgggaccgtcacactctacttggtggtcttgagctcgtggctcggtctctactccttacacccagctcggtaccaacacgaccccaggccagccctccacgcacgctacatcatacgacaacaaacnctcgcttcttcgtcgggtcctgtcctcgtcttctctcggacccttcctcttaccgtaaagggaaaactaacgcctaccgcccctacaccgcgtacccggaccgggggaccccaggacagatagatagtaattcgttagtttattaggttcgttcttacttatagtagtggtgtgtgtacttgtttcggtcggttcgggcggacgggtaccagtccgtcggccgttcgacggtccacgcccgtacggtccgttcccgtccccgttcggtaacccc

SEQ ID NO: 333023 - DNA, 621 bp, Homo sapiens
  misc_feature: GZ8MTXP01BEALW.15.59.F04.1.454.CMB.2.raw
  modified_base (267)..(267): a, c, t, g, unknown or other
  misc_feature (267)..(267): n is a, c, g, or t
  modified_base (375)..(375): a, c, t, g, unknown or other
  misc_feature (375)..(375): n is a, c, g, or t
  modified_base (402)..(402): a, c, t, g, unknown or other
  misc_feature (402)..(402): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctgtaccaacacgaccccaggccagcctccacgcaccgctcactctatancaacaaacactcgcttcttcgtcggggtcctgatcgcttctctggctccattccttaggaaacaaagctcgccctactaccccatcggacgggggcccagggaccagntgaatgaattcttagtttattattgtntctatatagtggtgcttggctagttcggtcgttcgggacggtacgggggacaaacgtccgtcggtaccgtccgtacggttacgaccggacccgaagggtcccgtccgccccccgttaacggtccgttacctcccgttccgttcccctcccgttccctttcggacccgttaacggtacgggtaacccgtagggtccggccgggggttcgcgggaaccggg

SEQ ID NO: 333024 - DNA, 710 bp, Homo sapiens
  misc_feature: GZ8MTXP01DQKA2.15.59.F04.1.454.CMB.2.raw
  modified_base (321)..(321): a, c, t, g, unknown or other
  misc_feature (321)..(321): n is a, c, g, or t
  modified_base (373)..(373): a, c, t, g, unknown or other
  misc_feature (373)..(373): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccctggagggacctcacactcacttgtggcttgagctctggctcggtctctactcccttacacccagctggtaccaacacgaccccaggccacgccctccacgcacgctcatctatagacaacaaacnctcgcttcttcgtcggggtccctgacctcgtcttcgtcctaggcccttaccncttcccgttaaagggaaaacctaaacggccttaccggacccccttacaacccgtacgtcccgggaaccccggggggcccaaggggtcctaagggattaggactacggtaaattccgtttaagttttaatttagttggtttacgttacctttagtaagttagttcgggttcgtcgttggtccgtttaggttttccgggttcggtttaaccgggggaccgggaaacggggtaccccgttaaaggtccggttacgttacccgggttccgtttaaaccgggtccgaaacccggtcccgtaacgggtccccgttcccggtcccccccggtttgggttccccc

SEQ ID NO: 333025 - DNA, 781 bp, Homo sapiens
  misc_feature: GZ8MTXP01CS9VB.15.59.F04.1.454.CMB.2.raw
  modified_base (369)..(369): a, c, t, g, unknown or other
  misc_feature (369)..(369): n is a, c, g, or t
tcagtctacgtagccacgaccggtgctcgatttagtacacacacttagggattgggggaaaggccctgaggaaaacaaaccccagctgggaagcctgagaacacttagccttcatgagtgtccccaccatggcctggaatgatgcttctcctcggactccttgcttatggatcaggagtggattctcagactggtggtgacccagggacgccattcgttctcagtcgtcccctgggacgggaccgtcacactctacttggtgtcttgagtctcgtggctcggtctcactcctactcccagctcgtaccaacacacccagccacgcctccacgccacgcctcacttctaatacgaccaaccaaaaccccncctacgtcttaccgttccgtcgggggttacccctggactccgtcctttcgtcctacgggtctacctacgtttaccctaagggtaaaaccaaaggtccctacggaccccttaccgaacccgtaacggttcccgggaacccggggggtacccccgaagggggaccctaagggggtaacgtacgggtaacttaagggttaaacctttacgttttagggttttttaaatttaaccgttttgggtttacgttaacccgtttaattaaggtttaaccgggttgggggttccggtcgttcgggttaccgtttacgggtttttcccgggttcgggttttacccgggggaacggggtaaaccggggtaacccgtaaacgggttcccgttacgggtaaccccggttaaccggttaaccgggg

SEQ ID NO: 333026 - DNA, 636 bp, Homo sapiens
  misc_feature: GZ8MTXP01EUOR4.15.59.F04.1.454.CMB.2.raw
  modified_base (373)..(373): a, c, t, g, unknown or other
  misc_feature (373)..(373): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtccccgtgggacgggccgtcacactcacttggtggcttggagctcgtggctcggtctctacctccttacctaccccagctacggtaccaacacgacccccaggcccacgcccctccacgccacgcctacactctatacgccaacaaaccncctacgccttcgttccgtacgggtcccctgactcgtctttctcgtcggctcctactccttaaggaaacaacgtcctacgacccctacacccacgtaccggaccgggggcccaagggccaagggtatacgtatacgtaactcgtttagttttattagtttcgtcttaccttatagtaagtgggttgtcgttggtacttacggtttccggttcgttcggggcggtacgggaacctacggtcgttaccggtcccgttcggtaacgg

SEQ ID NO: 333027 - DNA, 685 bp, Homo sapiens
  misc_feature: GZ8MTXP01AWA16.15.59.F04.1.454.CMB.2.raw
  modified_base (372)..(372): a, c, t, g, unknown or other
  misc_feature (372)..(372): n is a, c, g, or t
  modified_base (559)..(559): a, c, t, g, unknown or other
  misc_feature (559)..(559): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactggtggtcgacccaggacgccatcgttctcagtcgtccccgtggacggaccgtcacactcacttgtggtcttggacgtctcgtggtcttcggtcctcttaccttcccttaacctaccccagtcctacggtaacccaaacgaccgaacccccgaggacccaacgtccctccgaaccgccaaccgctccaattctaagtacgaccaaacaaacnccgtcgtccttcttcgtcggggtaccctggaccttcgtcttcgtccgtcggaccttaccaattcccgtaaagggaaacacgtcctacgccctacaccacgtcccggaaccgggggcccaggcaaggacttgacttatactttgttagtttattagggttgtacttacgtaattagttaggtcgggtnttcgtaggtctttacgttcgggtcgttcggggacgttaagggaccttaacggtcgtacccggttaccgttccgttacggggccaccggtccgaccggtcccgttccggtaacccccgttgtaaccc

SEQ ID NO: 333028 - DNA, 570 bp, Homo sapiens
  misc_feature: GZ8MTXP01CYKQ2.15.59.F04.1.454.CMB.2.raw
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (469)..(469): a, c, t, g, unknown or other
  misc_feature (469)..(469): n is a, c, g, or t
  modified_base (497)..(497): a, c, t, g, unknown or other
  misc_feature (497)..(497): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactggtggtgacccaggagccatcgttctcagtcgtcccctggacgggaccgtcacactcacttgtggcttgagctctggctcggtctctactccttacaccccagctaggtaccaacacgaccccaggccacgccctccacgcacgctcatctatagcaacaacactcgcttcttcgcggggtccctagacttcgcttctctggcctccnttcctaggaaacagctcgccctcaccngtccgacgggggcccaggcagtactgactagaacttcgttagttttactagttgttgtaccttatacttgtgggtcncgtggtattcgtttcggtcgttccgggnggacgggtaccagtccgtcgaccgttccgttaggtccacgtcccgaggtccttccgtccccgttcggttaacc

SEQ ID NO: 333029 - DNA, 558 bp, Homo sapiens
  misc_feature: GZ8MTXP01C4WS7.15.59.F04.1.454.CMB.2.raw
  modified_base (369)..(369): a, c, t, g, unknown or other
  misc_feature (369)..(369): n is a, c, g, or t
  modified_base (418)..(418): a, c, t, g, unknown or other
  misc_feature (418)..(418): n is a, c, g, or t
  modified_base (499)..(499): a, c, t, g, unknown or other
  misc_feature (499)..(499): n is a, c, g, or t
  modified_base (555)..(555): a, c, t, g, unknown or other
  misc_feature (555)..(555): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacctacccagctgtaccaacacgaccccaggccagccctccacgcaccgctcatctatagcacaaacactcgctcttcgtcggggtccctgatcgcttctctgctccatccttaggaaacaagcctcgccctccaccccactcgacggggcccaggccagngtgatagaatcttgtttattatttgtgttctatatagttgggtgtctgntgttcgtcgttcggcgggaggggacgaagcgtcgaccgttccgtgtcgacgcccgttttacgccgtccgcccctccgtccncctccttccgttcccctccccttccttccgttccgtaacgtacgcgtgcgcggcgngcg

SEQ ID NO: 333030 - DNA, 581 bp, Homo sapiens
  misc_feature: GZ8MTXP01ADOXM.15.59.F04.1.454.CMB.2.raw
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
  modified_base (566)..(566): a, c, t, g, unknown or other
  misc_feature (566)..(566): n is a, c, g, or t
tcagtctacgtagccacgaccggtgctcgatttagtacacacacttagggattggggggcctggatgatgcttctcctcggactccttgcttatggatcaggagtggattctcagactgtggtgacccaggagccatcgttctcagtgtcccctggagggacctcacactcacttgtggcttgagctctggctcggtctctactccttactaccccagctcggtaccaacacgacccccaggtcccagccctaccacgcacgctcatctatagcactaaaacgctcgcttctcgtagggtccctaggatcgcttctctaggctcctagtcccttaggaaaccaagtcncgccctnaccccagtcgaccgggggcccaggtaccagctgaacttgaacttcgtgtttatattggtacttctatntagtgggtnctggtctacgttcgtcgtacggcgacggggacgacgcgtcgtaccgtcgtacggcgaacgccgacggtcctccggtccccgtaacgtcttccgtccgttcccgttcccctaccgttcgttcgacgtcgtagcgngcggcggtcgcggcg

SEQ ID NO: 333031 - DNA, 643 bp, Homo sapiens
  misc_feature: GZ8MTXP01AZHXP.15.59.F04.1.454.CMB.2.raw
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtcgacccaggagccatcgttctcagtcgtccccgtggagggaccgtcacactcacttgtggcttgagctctgctcggtctctactccttactacccagctggtaccaacacgaccccaggccagcctcacgcacgctcatctatagcaacaacactcgctcttcgtggggtccctgactcgtcttcgtctacggccttcctaactcccgttaagggaaaacctaaacgcctacgcccctacaccctacgtccggaaccggggggccccaagggccaaggtaatggtaactaggaaactttcgtttagtttttaacttaggtttcgttagttcccttaagttacgttagtggggttctcgttggtcttacgtttcgggtcgttccgggaggttacgggaacttacgtcctcggttaacccgttcgttaacgggtccaacggcccgaacgggtcccttacccggtcccccgttcggtccc

SEQ ID NO: 333032 - DNA, 556 bp, Homo sapiens
  misc_feature: GZ8MTXP01DD19A.15.59.F04.1.454.CMB.2.raw
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
  modified_base (521)..(521): a, c, t, g, unknown or other
  misc_feature (521)..(521): n is a, c, g, or t
  modified_base (539)..(539): a, c, t, g, unknown or other
  misc_feature (539)..(539): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggacctcacactcacttgtggcttgagctctggctcggtctctactccttactacccagctgtaccaacacgaccccaggccagcctccacgcacgctcatctatagcacaaacactcgctcttcgtcgggtcccctgatcgtcttctctggctccatccttaggaaacaagctgccctcaccccatcgacggggcccaggctantgatagaatctagtttattatgtntctaatatagtggtatcgtgactgtttcggtacttcgggacggagggggaccctaaagctacgacccgtccgtaaggtcacgcccaaggccctcgccccctgtcaccttcttccgttccccgacccttccgttcncctaacggactaaccggnggcgcggtcgcggaacg

SEQ ID NO: 333033 - DNA, 654 bp, Homo sapiens
  misc_feature: GZ8MTXP01AUYF2.15.59.F04.1.454.CMB.2.raw
  modified_base (380)..(380): a, c, t, g, unknown or other
  misc_feature (380)..(380): n is a, c, g, or t
  modified_base (464)..(464): a, c, t, g, unknown or other
  misc_feature (464)..(464): n is a, c, g, or t
tcagtctacgtagccacgaccggtgctcgatttagtacacacacttagggattgggggaaaaggccctgaggaaaaacaaaccccagctgggaagcctgagaacacttagccttcatgagtgtccccaccatggcctggatgatgcttctcctcggactccttgcttatggatcaggagtggattctcagtactggtggtcgaacccgaggacgccattcggttctcgagtcgtccccgtgggacggaccgtcacactctacgttggtgtcttggagtctcgtgctcggtctctacctcctaccaccagctcgaccacaccgacccagccacgccctaccacgcaccgtctacatactactacgaccaaccgtaaacccnccgtacgtcttccgttcggttaaccgggtccctgtacgtccgtcttcgtcgtcgctaccacttcgtaacgaaacgatccgtacnccctacaccgtacgccgggaccggggaccaggaccagggtagtacgtaagtacgtaaactttcgttaattttgttaagtttcgttccttaggtattaggttcggtagggttcgttacgttcggtcgtttacggttccggttggttaccggggaacggtacgtaacgacgtcgacggtcccgttcgaacgg

SEQ ID NO: 333034 - DNA, 593 bp, Homo sapiens
  misc_feature: GZ8MTXP01DNQKK.15.59.F04.1.454.CMB.2.raw
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
  modified_base (501)..(501): a, c, t, g, unknown or other
  misc_feature (501)..(501): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (570)..(570): a, c, t, g, unknown or other
  misc_feature (570)..(570): n is a, c, g, or t
tcagtctacgtagccacgaccggtgctcgatttagtacacacacttagggattggggggaaaaggccctgaggaaaaacaaaccccagctgggaagcctgagaacacttagccttcatgagtgtccccaccatggcctggatgatgcttctcctcggactccttgcttatggatcaggagtggattctcagactggtggtgaccccaggagccatcgttctcagtcgtcccctgggacgggacctcacactcattggtgcttgagctcgtggctcggtctctactcctacctacccagctggaccaacacgaccccaggcccagcccctaccacncacgcctcatctatacgacaactaaaccnctacgcttccttcgccggggtccctgtactccgtcttcncgtcgtcctacctacgttaccttaacggaaacacgtccttcgacccctacaccagtcccgggaccgggaccaggaccagggtactggatagtaacttnttagtttatagttntagtctatntaagtggttgcttggtcttgttcgttcgttcgaacggtagaaccgngtccgttcgtccgttcggtaacg

SEQ ID NO: 333035 - DNA, 735 bp, Homo sapiens
  misc_feature: GZ8MTXP01BN1T4.15.59.F04.1.454.CMB.2.raw
  modified_base (273)..(273): a, c, t, g, unknown or other
  misc_feature (273)..(273): n is a, c, g, or t
  modified_base (373)..(373): a, c, t, g, unknown or other
  misc_feature (373)..(373): n is a, c, g, or t
tcagtctacgtagccacgaccggtgctcgatttagtacacacacttagggattggggggaaaaggccctgaggaaaacaaaccccagctgggaagcctgagaacacttagccttcatgagtgtccccaccatggcctggatgatgcttctcctcggactccttgcttatggatcaggagtggattctcagactggtggtcgacccgaggacgcctattcgttctcagtcgtccccgtgggacgggaccgtcacactctacgttgtggtcttgngtctcgtggctcggtctctactcctactacccagctcggtaccaacacgaccccaggccagccctccacgcacgctcactctatacgacaaccaaacccncctcgtccttcttccgtcgggggtcccctggacttccgtctttcctcgtcgggtaccttacccgtacttacccgttaacgggtaaaaccaaacgtccgttaccgtccccctaccgtaacccgcggtacccgggaaccccggggggccccaaacggggtcccgaggggtaacgtagggtaaccttacggttaaatttccgtttaggtttttatttaagttttcggttacgttacctttaagttagttaagggttgggttcggtcggttcggtcgtttacggttttcccggggttcgttcgggggtaacgggtacggggtaacctaacgggtccgttaccgggtaacccggttccgtaaccggg

SEQ ID NO: 333036 - DNA, 776 bp, Homo sapiens
  misc_feature: GZ8MTXP01BZ58X.15.59.F04.1.454.CMB.2.raw
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtggtcgacccgaggagccatcgttctcagtcgtccccgtgggacgggtaccgtcacctactctacttggtcggtcttggagtcctcgtggtctcggtcttctacctcccttaacctaccccagtccgtacggtacccaaacgaccgaccccgaggcccacgcccctccgaccgccaccgcctacacttacttaactacgaccaacgaaaaccctccgtccgtcttccgttccggttccggggtacccctggtacttccggtcctttcgtccgtcggaccttaccctacttaccggttaacgaaaaccgtaacgtcctaccgtccccttacctaaacccgtacggtacccgggaacccgggggcccgaagggacccgtaaggggtagttaacggtaacgttagttaaacttcggtttttaagtttaactttaggttcgtttacggttacccttaagttagttaagggttgggttcgtcggttcgggttacgtttacggtttccgggttcgggttacccgggggaacggggtaccgggtaaccgtacggtacccggttccggtaacccggttccgggttaaccg

SEQ ID NO: 333037 - DNA, 516 bp, Homo sapiens
  misc_feature: GZ8MTXP02F3L4Z.15.59.F04.1.454.CMB.2.raw
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttaggaaacaaagctgccctcacccatccgacggggcccaggcagntgatgaatctagtttattattgtgtcctatatatggtnctggctagtttcgcttcgggcggaggaccagctgaccgtctaggtcacgccaggctcgcccctggcactctcgtcccacctcctcgctaacgtacgacgtcgacgcggctcggacg

SEQ ID NO: 333038 - DNA, 515 bp, Homo sapiens
  misc_feature: GZ8MTXP02HEKX0.15.59.F04.1.454.CMB.2.raw
  modified_base (354)..(354): a, c, t, g, unknown or other
  misc_feature (354)..(354): n is a, c, g, or t
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctctctggggtccctgactcgcttctctggctcntccttggaaacaaagctgccctcaccatcacggggcccaggcagatgatgaatctagtttattattgtgtcctatatatgggtgctggctagtttcggtcttcgggcggagggaccaaagctcgaccgtcctaggtcagcccgaaggctcgcccctcgtcc

SEQ ID NO: 333039 - DNA, 518 bp, Homo sapiens
  misc_feature: GZ8MTXP02GWB7I.15.59.F04.1.454.CMB.2.raw
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtcccctgatcgcttctctggctccatccttaggaaacaaagctgccctcaccccatcgacggggcccaggcagntgatgaatctgtttattattgtgtcctatatatgggtnctggctatttcggcttcggcggaggaccaagctgaccgtctaggcagcccaaggctcgccccctggtcactctcgttccccgcctcctcgctaacgtagacctgacgcgggctggacg

SEQ ID NO: 333040 - DNA, 512 bp, Homo sapiens
  misc_feature: GZ8MTXP02J3UOX.15.59.F04.1.454.CMB.2.raw
  modified_base (355)..(355): a, c, t, g, unknown or other
  misc_feature (355)..(355): n is a, c, g, or t
  modified_base (440)..(440): a, c, t, g, unknown or other
  misc_feature (440)..(440): n is a, c, g, or t
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaacagacccccaggccagcctccacgcacgctcatctatagcacaaacactggctcttctggggtccctgactcgcttctctggctcntccttaggaaacaagctgccctcaccatcacgggggcccaggcagatgatgaatctgtttattattgtgtcctatatatgggttnctgggctagtttcggtcttcggcggagggaccagctgaccgtctaggcagcccaggctcgcccctcggtacc

SEQ ID NO: 333041 - DNA, 519 bp, Homo sapiens
  misc_feature: GZ8MTXP02GUJQP.15.59.F04.1.454.CMB.2.raw
  modified_base (439)..(439): a, c, t, g, unknown or other
  misc_feature (439)..(439): n is a, c, g, or t
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaacacgaccccaggccagcctccacgcacgctcatctatagcacaaaacactcgctcttctggggtccctgactcgcttctctgctcatccttaggaaacaaagctgccctcaccatccgacggggcccaggcagatgatgaatctgtttatattgtgtctatatatgggtnctggctagtttcggtcttcggcggagggaccaaaggctcgaccgtcctaggtcacgcccaaggcctcgccccctggtccc

SEQ ID NO: 333042 - DNA, 516 bp, Homo sapiens
  misc_feature: GZ8MTXP02G4ZXZ.15.59.F04.1.454.CMB.2.raw
  modified_base (467)..(467): a, c, t, g, unknown or other
  misc_feature (467)..(467): n is a, c, g, or t
tcagtctacgtagccacgaccggtgctcgatttagtacacacacttagggattggggaaaggccctgaggaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaaccactcgctcttctggggtccctgatcgcttctctgctccatccttaggaaacaagctgccctcaccatcgacggggcccaggcagatgatgaatctgttattatgtgtcctatatatgggtnctggctagtttcggtcttcgggcggagggaccaagctcgaccgtctagg

SEQ ID NO: 333043 - DNA, 524 bp, Homo sapiens
  misc_feature: GZ8MTXP02GB4DZ.15.59.F04.1.454.CMB.2.raw
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctgctccatcccttaggaaacaaagctgccctcaccccatcgacggggcccaggcagntgatgaatctgtttattattgtntctatatatgggtnctggctatttcggtcttcggcggagggaccaagctgaccgtccgtaggtcagcccaaggcctcgccccctcggtcactctcgttcccaccctcctcgctaacgtacgactcgacgcggctggacg

SEQ ID NO: 333044 - DNA, 528 bp, Homo sapiens
  misc_feature: GZ8MTXP02FSXEF.15.59.F04.1.454.CMB.2.raw
tcagtctacgtagccacgaccggtgctcgatttagtacacacacttagggattgggggcctggatgatgcttctccccggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtcccctgatcgcttctctggctccatccttggaaacaaagctgccctcaccatcacggggcccaggcagatgatgaatctgtttattattgtgtctatatatgggtgctggctagttttcggtcgttcgggcgggtagggaccaaggctgaccgtcctaggtcagcccaaggctcgccccctcggtccactctcgttcccgccctcctcgctacgtaagactgacgcggctggcaacgg

SEQ ID NO: 333045 - DNA, 529 bp, Homo sapiens
  misc_feature: GZ8MTXP02II79J.15.59.F04.1.454.CMB.2.raw
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctcttctggggtcccctgatcgcttctctggctccatccttggaaacaaagctgccctcacccatcacggggcccaggccagntgatgaatctgtttattattgtgtcctatatatgggtncgtggctagtttcgtcttcgggcggtagggacccaagctagacccgtccgtaggtcagcccaaggctcgccccctcggtcacgtctcgttcccgccctcctcgctaacgtagactgacgcggactggacg

SEQ ID NO: 333046 - DNA, 506 bp, Homo sapiens
  misc_feature: GZ8MTXP02IUQ93.15.59.F04.1.454.CMB.2.raw
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtcccctgatcgcttctctggctccatccttggaacaaagctgccctcacccatcacggggccaggcagntgatgaatctgtttattatgtgtcctatatatgggtnctggctatttcggtcttcggcggtaggaccagctgaccgtctaggtcagccaggctgccccctggtcactctcgtcccgcctcctcgctaacgtagactgagcggctggac

SEQ ID NO: 333047 - DNA, 523 bp, Homo sapiens
  misc_feature: GZ8MTXP02ILSQJ.15.59.F04.1.454.CMB.2.raw
  modified_base (363)..(363): a, c, t, g, unknown or other
  misc_feature (363)..(363): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctcttctggggtcccctgatcgctttctctggctccatcccttggaaacaaagctgccctcacccatcacggggcccaggcagntgatgaatctgtttattattgtgtcctatatatgggtgctggctagtttcgtcttcgggcggagggaccaagctgaccgtccgtaggtcagcccaaggctcgcccctcggtcactctcgttcccgccctcctcgctaacgtacgactgagcggctggacg

SEQ ID NO: 333048 - DNA, 526 bp, Homo sapiens
  misc_feature: GZ8MTXP02FJVSC.15.59.F04.1.454.CMB.2.raw
  modified_base (410)..(410): a, c, t, g, unknown or other
  misc_feature (410)..(410): n is a, c, g, or t
tcagtctacgtagccacgaccggtgctcgatttagtacacacacttagggattggggaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactacccccagctggtaccaacagaccccaggccagcctccacgcacgctcatctatagcacaaaccactcgctcttctggggtccctgatcgcttctctggctccatccttggaaacaaagctgccctnaccatcacggggcccaggcagatgatgaatctgtttattattgtgtcctatatatgggtgctggctagtttcggtctttcgggcgtaggggacccaaggcctaggaccgtcctagg

SEQ ID NO: 333049 - DNA, 526 bp, Homo sapiens
  misc_feature: GZ8MTXP02FSXPU.15.59.F04.1.454.CMB.2.raw
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcattactaccccagctggtaccaacagaccccaggccagcctccacgcacgctcatctatagcacaaacactcgctcttctggggtcccctgatcgcttctctggctccatccttggaaacaaagctgccctccaccatcacggggcccaggcagatgatgaatctgtttattattgtgtcctatatagtgggtgctggctagtttcggtcgttcgggcgggtagggaccaagcgtgacccgtcgtaggtcagcccaaggctcgcccctcggtcactctcgttccccgccctcctcgcgtacgtacgactgacgcggctcgg

SEQ ID NO: 333050 - DNA, 533 bp, Homo sapiens
  misc_feature: GZ8MTXP02JAP5R.15.59.F04.1.454.CMB.2.raw
  modified_base (354)..(354): a, c, t, g, unknown or other
  misc_feature (354)..(354): n is a, c, g, or t
  modified_base (479)..(479): a, c, t, g, unknown or other
  misc_feature (479)..(479): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagcctggtaccaacagacccccaggcccagccctccacgcacgctcatctatagcacaaaccnctcgctcttctcggggtccctgactcgcttctctggctccatccttaggaaacaagctgccctcaccatcgacggggcccaggcagactgatgaatctagttattattgtgtctatatagtggtncgtggctagtttcggttcttcgggcggtaggaccaagcgtcgaccgtcgtacgg

SEQ ID NO: 333051 - DNA, 509 bp, Homo sapiens
  misc_feature: GZ8MTXP02HFJV2.15.59.F04.1.454.CMB.2.raw
  modified_base (356)..(356): a, c, t, g, unknown or other
  misc_feature (356)..(356): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgactcgcttctctggctccntccttggaaaccaaagctgccctcaccatcacggggcccaggcagatgatgaatctagtttattattcgtgtcctatatatgggtnctggctatttcgtnttcggcggagggaccaagctgaccgtctagcagcccaggctcgcccctcgtcc

SEQ ID NO: 333052 - DNA, 620 bp, Homo sapiens
  misc_feature: GZ8MTXP02JKSWS.15.59.F04.1.454.CMB.2.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
  modified_base (564)..(564): a, c, t, g, unknown or other
  misc_feature (564)..(564): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctcgtgctcgtctctactcctacctacccngctcgtaccaanaccgacccnggccacgccctccacgcacgctcatctatcgcaacaaacactcgcttcttcgtcgggtcccctgactcgtcttctcgtcggcctcctacttcccgttaaaggaaaacaacgtctaccgcccctacacccctanccggaccggggcccaggaccaagtctgatagtaacttcgttagttttaattagttcgttnttacctatatagtggtntcgtgtcttgttcggtcgttacgggnggtaacggaccgaagtccgtacgtaccgtccgtagtacgacgacccgaggtcctcccgccccgttcggtccaccggttcctccggttcccccncccgttaccgccgtaccgtaacgtacgtacgtcggacggcccggtagcggaaccgg

SEQ ID NO: 333053 - DNA, 535 bp, Homo sapiens
  misc_feature: GZ8MTXP02F4K1L.15.59.F04.1.454.CMB.2.raw
  modified_base (478)..(478): a, c, t, g, unknown or other
  misc_feature (478)..(478): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaaccactcgctcttcgtcggggtccctgactcgcttctctgctccatccttaggaaacaagctgccctcaccatccgacggggcccaggcagactgatagaatctgtttattattgtgtctatatagtggtncgtgctacgtttcggtcttcgggaacggtagggaccacgcgtacgtaccgtctacgg

SEQ ID NO: 333054 - DNA, 547 bp, Homo sapiens
  misc_feature: GZ8MTXP02H40QG.15.59.F04.1.454.CMB.2.raw
  modified_base (376)..(376): a, c, t, g, unknown or other
  misc_feature (376)..(376): n is a, c, g, or t
  modified_base (444)..(444): a, c, t, g, unknown or other
  misc_feature (444)..(444): n is a, c, g, or t
tcagtctacgtagccacgaccggtgctcgatttagtacacacacttagggattgggggaaaaggccctaaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatacgcaacaaacacctcgctctcgtcggggtccctgntcgcttcctctgctccactccttagaaacaaagctcgccctcacccatccgaccggggccaggcagangatgaatcttgtttattatttgtgttctatatagtgggtgcgtcggtctacgtttcggtcgttcgggcggtaagggaccaaggctacgaccgtcgtacggccg

SEQ ID NO: 333055 - DNA, 531 bp, Homo sapiens
  misc_feature: GZ8MTXP02IQKT1.15.59.F04.1.454.CMB.2.raw
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctcttctggggtcccctgatcgcttctctggctccatccttaggaaacaaagctgccctcacccatcgacggggcccaggcagntgatgaatctgtttattatgtntctatatagtgggtnctggctagtttcggtcttcgggcggtagggacctaagctaggaccgtccgtaggtcacgcccaaggctcgcccctcggcactctcgttcccaccctcctcgctaacgtacgactcgacgcgggctcggacg

SEQ ID NO: 333056 - DNA, 605 bp, Homo sapiens
  misc_feature: GZ8MTXP02IQ1ZV.15.59.F04.1.454.CMB.2.raw
  modified_base (373)..(373): a, c, t, g, unknown or other
  misc_feature (373)..(373): n is a, c, g, or t
  modified_base (413)..(413): a, c, t, g, unknown or other
  misc_feature (413)..(413): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcaacaaacactcgctcttcgtggggtcccctgatcgtcttctctggctccattcccttaggaaacaaacgctcgccctcacccactccgaccggggcccaggcagntgatgaattcttgtttattattgtgtctatatagtgggtncgtggtctagtttcggtcgttcgggacggagggaccaaggcctaggaccccgttaccgtaggtacgacgtacccgaaggtccgtccgccccccgttcggtaccctaccgttcccttaccgttccccctaccccgttcccgtaccgtccgttaaaccgtcgaccgttcgggacggccgggtcgtacgggaccg

SEQ ID NO: 333057 - DNA, 531 bp, Homo sapiens
  misc_feature: GZ8MTXP02IH3U3.15.59.F04.1.454.CMB.2.raw
  modified_base (357)..(357): a, c, t, g, unknown or other
  misc_feature (357)..(357): n is a, c, g, or t
  modified_base (446)..(446): a, c, t, g, unknown or other
  misc_feature (446)..(446): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccacacgaccccaggccagcctccacgcacgctcatctatagcaacaaacactcgctcttctggggtccctgactcgcttctctgctccntccttggaaacaagctgccctcaccatccgacgggggcccaggcagatgatgatctgtttatttatgttgtccttatatagtggggttncgtgtcttagtttcggtcgttcgggcggacggacacgctacgaccgttcgtacgtcgacgaccgacggcctccgccccgtacgtc

SEQ ID NO: 333058 - DNA, 504 bp, Homo sapiens
  misc_feature: GZ8MTXP02F2HV2.15.59.F04.1.454.CMB.2.raw
  modified_base (358)..(358): a, c, t, g, unknown or other
  misc_feature (358)..(358): n is a, c, g, or t
  modified_base (394)..(394): a, c, t, g, unknown or other
  misc_feature (394)..(394): n is a, c, g, or t
  modified_base (459)..(459): a, c, t, g, unknown or other
  misc_feature (459)..(459): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (501)..(501): a, c, t, g, unknown or other
  misc_feature (501)..(501): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctctctggggtcccctgatcgcttctctggctccatcctggaaacaaagctgccctcacccatcacggggcccaggcagntgatgaatctgtttatattgtgtctatatatgggtnctgactgttcgtcgttcggcggaggacagctacgaccgtcgtagcacgccgagctcgccctcgcnctctcgtcccncctccncnctaacgtcgactcgacgcggcgngcg

SEQ ID NO: 333059 - DNA, 532 bp, Homo sapiens
  misc_feature: GZ8MTXP02FXW6S.15.59.F04.1.454.CMB.2.raw
  modified_base (389)..(389): a, c, t, g, unknown or other
  misc_feature (389)..(389): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctctctggggtccctgatcgcttctctggctccatcccttggaaacaaagctgcccctcaccccatccgacggggccccaggccagatgatgaatcttgtttattattgtntcctatatatgggtgctggctatttcggtcttcgggcggagggaccaagctacggaccgtccgtaggtcacgcccaaggcctcgcccctcggtcactctcgttcccaccctcctcgctaacgtacgactgacgcggctggacg

SEQ ID NO: 333060 - DNA, 531 bp, Homo sapiens
  misc_feature: GZ8MTXP02IC0DX.15.59.F04.1.454.CMB.2.raw
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (483)..(483): a, c, t, g, unknown or other
  misc_feature (483)..(483): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctctctggggtcccctgatcgcttcnctggctccatccttaggaaacaaagctgccctcacccatcgacggggcccaggcagntgatgaatctgtttattatgtgtcctatattatgggtgctggtctagtttccggtcttcgggcgggtacgggacaagtctggacccgtccgtaaggtcagcccaggcctcgcccctcggtcnctctcgttcccgcctcctcgctaacgtacgactgacgcggctcggacg

SEQ ID NO: 333061 - DNA, 540 bp, Homo sapiens
  misc_feature: GZ8MTXP02GWVEX.15.59.F04.1.454.CMB.2.raw
tcagtctacgtagccacgaccggtgctcgatttagtacacacacttagggattgggggcctggatgatgcttctccccggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacactcgctcttctcgggtccctgatcgcttctctggctccatccttaggaaacaagctcgccctcaccactccgaccggggcccaggcagatgatgaatctgtttattattgtgtctatatagtggtgctggctagtttcggtcgttcggcggtaggaccaagctcgaccgtccgtaggtcacgcccgaaggcctcgccccgtcggtccactcctcgttcccgccctccgcgtctacgtaagacgtcgacggcggctcggacgacgg

SEQ ID NO: 333062 - DNA, 533 bp, Homo sapiens
  misc_feature: GZ8MTXP02II1D4.15.59.F04.1.454.CMB.2.raw
  modified_base (360)..(360): a, c, t, g, unknown or other
  misc_feature (360)..(360): n is a, c, g, or t
  modified_base (515)..(515): a, c, t, g, unknown or other
  misc_feature (515)..(515): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctcacgcacgctcatctatagcacaaacactcgctcttctggggtcccctgatcgcttctctggctccatccttggaaacaagctgccctcacccatccgacggggcccaggcagntgatgaatctgtttattatgtgtcctatatagtggtgctggctagtttcggtcgttccgggcggtacgggaccaaagctacggacccgtcgtaggtcacgcccaaggctcgccccctcggcacctctcgttccccaccctcctcgctaaccgtanacctgagcggctcggacg

SEQ ID NO: 333063 - DNA, 544 bp, Homo sapiens
  misc_feature: GZ8MTXP02H2URV.15.59.F04.1.454.CMB.2.raw
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
  modified_base (490)..(490): a, c, t, g, unknown or other
  misc_feature (490)..(490): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggtcttgagctctggcttcggtctctactccttactaccccagctcggtaccaacacgaccccaggccacgccctccacgcacgctcatctatagcacaaccactcgctcttcgtcggggtccctgactcgtccttctctcgctccatcctaggaaacaacgctcgccctcaccagtccgaccggggccaggcagntagatgaatcttagtttattattgtntactatatagtgggtnctggcttacgtttcggtgttcgggcgtacgggactacgctacgacgtcgtacgg

SEQ ID NO: 333064 - DNA, 527 bp, Homo sapiens
  misc_feature: GZ8MTXP02GNJRW.15.59.F04.1.454.CMB.2.raw
  modified_base (355)..(355): a, c, t, g, unknown or other
  misc_feature (355)..(355): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctcttctggggtccctgactcgcttctctggctccntccttggaaacaagctgccctcaccatcgacggggcccaggcagatgatgaatcttagtttattattgttgtcctatatagtgggtgcgtggtctagtttcggtcgttcgggtcgggagggacccaaggctcgaccgtctaggtcacgccaacggctcgccccgtcggtccc

SEQ ID NO: 333065 - DNA, 537 bp, Homo sapiens
  misc_feature: GZ8MTXP02GF5X7.15.59.F04.1.454.CMB.2.raw
  modified_base (359)..(359): a, c, t, g, unknown or other
  misc_feature (359)..(359): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacactcgctcttcgtggggtccctgactcgcttctctgctcntctagaaacaagctagccctcaccatcgacgggggcccaggcagatgatgaatcttagtttattattgttgttcctatattagtgggtgtcgtggtctagtttcggtcgtttcgggcgggaggtaccgaagctcgacccgtcgtacggtcacgcccgaaggcctcgccccctcggtcc

SEQ ID NO: 333066 - DNA, 521 bp, Homo sapiens
  misc_feature: GZ8MTXP02IOSUJ.15.59.F04.1.454.CMB.2.raw
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
  modified_base (498)..(498): a, c, t, g, unknown or other
  misc_feature (498)..(498): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgcncatctatagcacaaacactcgctcttctggggtccctgactcgcttctctggcctccntccttggaaacaaagctgccctcaccatcacgggggcccaggcagatgatgaatctgtttattattgtgtccttatatagtgggtgtctggctagtttcggtctttcgggcggaggggacctaaagctcgaccgtctaggtcncgccaaggctcgcccctcggtcc

SEQ ID NO: 333067 - DNA, 593 bp, Homo sapiens
  misc_feature: GZ8MTXP02IS4B2.15.59.F04.1.454.CMB.2.raw
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
  modified_base (424)..(424): a, c, t, g, unknown or other
  misc_feature (424)..(424): n is a, c, g, or t
  modified_base (586)..(586): a, c, t, g, unknown or other
  misc_feature (586)..(586): n is a, c, g, or t
tcagtctacgtagccacgaccggtgctcgatttagtacacacacttagggattgggggccgtggatgatgcttctcctcggactccttgcttatggatcaggagtggattctcagactgtggtgacccaggagccatcgttctcagttgtcccctggagggaccgtcacactcacttgtggcttgagctcgtggctcggtctctactccttacctaccccagctggtaccaacgacgaccccaggccagcctccacgcacgctcatcctatagcaacaaacactcgctcttcgtggggtacccctgactcgcttcnctggactccatcccgttaggaaacaagctcgccctnacccatcgacggggcctaggcagctgatagaaactcttagtttattattgtacgttactatatagtcgggtntcgtggtctagtttcggtcgtttacgggacggagggaaccaagccgtacggacccgttacgtacggtctacggcccgaaggtcctcgccccccgtggtactccgttccgtccgttcccctaccctcctacggtcctaacgtacgtacgtcggacgccgggcncggaccg

SEQ ID NO: 333068 - DNA, 539 bp, Homo sapiens
  misc_feature: GZ8MTXP02GBOQL.15.59.F04.1.454.CMB.2.raw
  modified_base (363)..(363): a, c, t, g, unknown or other
  misc_feature (363)..(363): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctcttctggggtcccctgatcgcttctctggctccatccttggaaacaaagctgccctcaccccatcgacggggcccaggcagntgatgaatctgtttattattgtgtcctatatagtggtgctggctatttcgtcgttcggcggtagggaccaagctacgaccgtccgtaggtcacggcccaaggcctcgcccccgtcggtccactctccgttcccacccctcctccgtcctaacgtacgactcggacgcggctggacg

SEQ ID NO: 333069 - DNA, 537 bp, Homo sapiens
  misc_feature: GZ8MTXP02GIIM2.15.59.F04.1.454.CMB.2.raw
  modified_base (482)..(482): a, c, t, g, unknown or other
  misc_feature (482)..(482): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtccccctggagggaccgtcacactcacttgtggcttgagctctggctcggtctctactccttactaccccagcctggtaccaacagaccccagccagcctccacgcacgctcatctatagcacaaaccactcgctcttctcggggtccctgactcgcttcctctgctcccatcccttaggaaacaaagctacgccctcaccatcgacggggcccaggcagatgatgaatctagttattattgtgtctatattagtgggtncgtggctagtttcgtcgttcggcggtagggaccaaggctcgacccgtcgtaacgg

SEQ ID NO: 333070 - DNA, 541 bp, Homo sapiens
  misc_feature: GZ8MTXP02IPIDK.15.59.F04.1.454.CMB.2.raw
  modified_base (423)..(423): a, c, t, g, unknown or other
  misc_feature (423)..(423): n is a, c, g, or t
  modified_base (467)..(467): a, c, t, g, unknown or other
  misc_feature (467)..(467): n is a, c, g, or t
  modified_base (483)..(483): a, c, t, g, unknown or other
  misc_feature (483)..(483): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagcctggtaccaacacgaccccaggccagccctccacgccacgctcatctatagcacaaaccactcgctcttctcggggtccctgactcgcttctctggctccatccttggaaacaaagctcgccctcaccntccgacgggggcccaggcagatgatgaatctgtttattattgtnttctatatagtgggtntcgtggctagtttcggtctttcgggcggtacgggaccaaggcgtcgaccgtccgtagg

SEQ ID NO: 333071 - DNA, 539 bp, Homo sapiens
  misc_feature: GZ8MTXP02I9AWP.15.59.F04.1.454.CMB.2.raw
  modified_base (368)..(368): a, c, t, g, unknown or other
  misc_feature (368)..(368): n is a, c, g, or t
  modified_base (406)..(406): a, c, t, g, unknown or other
  misc_feature (406)..(406): n is a, c, g, or t
  modified_base (492)..(492): a, c, t, g, unknown or other
  misc_feature (492)..(492): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcaacaaacactcgctcttctcggggtccctgactcgcttctctggctccatcccttaggaaacaaagctcgccctcaccccatccgacggggcccaggcagntgatgaatctagtttattattgtgtctatatatgggtnctggctagtttcggcgtttcgggcggtaagggaccaagctacggacccgtccgtaggtccagcccaaggctgccctccgtcgtacncgtctcgtccccacctcctacgctacgtacactgacggcggctacgg

SEQ ID NO: 333072 - DNA, 523 bp, Homo sapiens
  misc_feature: GZ8MTXP02FKE9T.15.59.F04.1.454.CMB.2.raw
  modified_base (363)..(363): a, c, t, g, unknown or other
  misc_feature (363)..(363): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggcccagcctccacgcacgctcatctatagcacaaacactcgctcttctggggtcccctgatcgcttctctggctccatccctggaaacaaagctgccctcaccccatccacggggcccaggcagntgatgaatctgtttattattgtgtcctatatatgggtgctggctatttcggtcttcgggcggtagggaccaagctgaccgtcctaggtcagcccaaggctcgccccctcggtcactctcgtcccaccctcctcgctaacgtagactgacgcggctggacg

SEQ ID NO: 333073 - DNA, 526 bp, Homo sapiens
  misc_feature: GZ8MTXP02GUFQR.15.59.F04.1.454.CMB.2.raw
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctcttctggggtccctgatcgcttctctggctccatcccttaggaaacaaagctgccctcaccccatcacggggcccaggcagntgatgaatctgtttattatgtgtcctatatatgggtnctggctatttcggtcttcgggcggtagggaccaagctcgaccgtcctaggtcagcccaaggctcgccccctcggtcactctcgtcccaccctcctcgctaacgtagactcgacgcgggctcggacg

SEQ ID NO: 333074 - DNA, 577 bp, Homo sapiens
  misc_feature: GZ8MTXP02H2GWP.15.59.F04.1.454.CMB.2.raw
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacactcgctcttcgtggggtcccctgatcgcttctctgctccatccttaggaaacaaagcctcgccctcaccccatccgacggggcccaggcagntgatgaatcttgtttattattgtntcttatatagtgggtgcgtggctagtttcggtcgtttcggggcggagggtaccaaggtcctacggtacccgtccgtaaggtccacggaccccaaagggtcctcccggtcccccgtcggtcctaccgttccttcgttccccctaccctccttccgcctaacgtacgacgtcggacgcggctggacg

SEQ ID NO: 333075 - DNA, 536 bp, Homo sapiens
  misc_feature: GZ8MTXP02HEU5S.15.59.F04.1.454.CMB.2.raw
  modified_base (401)..(401): a, c, t, g, unknown or other
  misc_feature (401)..(401): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctcttctggggtcccctgatcgcttctctggctccatcccttggaaacaaagctgccctcacccatcgacggggcccaggcagatgatgaatctgtttattattgtgtcctatatatgggtnctggctagtttcggtcttcgggcggtagggaccagctggaccgtccgtaggtcacgtcccaaggcctcgcccccgtcggtcactctcgtccccaccctcctccgactcgtacgacgtcgacggcggcgtggaccg

SEQ ID NO: 333076 - DNA, 541 bp, Homo sapiens
  misc_feature: GZ8MTXP02GBY18.15.59.F04.1.454.CMB.2.raw
  modified_base (352)..(352): a, c, t, g, unknown or other
  misc_feature (352)..(352): n is a, c, g, or t
  modified_base (470)..(470): a, c, t, g, unknown or other
  misc_feature (470)..(470): n is a, c, g, or t
  modified_base (484)..(484): a, c, t, g, unknown or other
  misc_feature (484)..(484): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttactaccccagctggtaccaacacgaccccaggccagcctccacgcacgctcatctatagcacaaaccnctcgctcttcgtcggggtccctgactcgcttctctggctccatccttaggaaaactaagctcgccctcacactccgaccggggcccaggcagatgatgaatcttagtttattattgtntctatatagtggtncgtggctacgtttcggtcgttcgggcggtacggaccaggcgtcgaccgtccgtacgg

SEQ ID NO: 333077 - DNA, 556 bp, Homo sapiens
  misc_feature: GZ8MTXP02G4HUS.15.59.F04.1.454.CMB.2.raw
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacctaccccagctggtaccaacacgaccccaggcccacgccctccacgccacgctcatctatacgcaacaaacnctcgctcttcgtcggggtccctgactcgcttctctgcctcntccttaggaaacaagctcgccctcaccatccgacgggggccaggcagangatgaactcttagtttattagttgttgtcctattatagttgggtgtcgtggcttagtttcggttcgttcgggacgggtacggaccaggctcgaccgtccgtaacggtcacggcccgacggcctccggtccccgtcggtccc

SEQ ID NO: 333078 - DNA, 539 bp, Homo sapiens
  misc_feature: GZ8MTXP02J2UYF.15.59.F04.1.454.CMB.2.raw
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (519)..(519): a, c, t, g, unknown or other
  misc_feature (519)..(519): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggaggaccgtcacactcacttgtggcttgagctctggctcggtctctactcctactaccccagctggtaccaacagacccccaggcccagccctcacgcacgctcatctatagcacaaacactcgctcttctggggtccctgatcgctttcnctgctccatccttggaaacaaagctgcccctcaccccntcacggggcccaggcagntgatgaatctgtttattattgtgttcctatatatggggtgcttggctatttcgggttctttcggcgggtaagggaccaaaggctgaccgtccctaggtcagccccgaaaggcctgcccccctcggtcacctctcgttccccgccctcctcgctaacgngactggagcgggctgggacg

SEQ ID NO: 333079 - DNA, 550 bp, Homo sapiens
  misc_feature: GZ8MTXP02IQOR9.15.59.F04.1.454.CMB.2.raw
  modified_base (357)..(357): a, c, t, g, unknown or other
  misc_feature (357)..(357): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacactcgctctctggggtccctgactcgcttctctggctccntccttaggaaacaaagctgccctcaccatcgacgggggcccaggcagatgatgaatcttgtttattattgtntcctatatatggtncgtaggctagtttcggtcgttcgggacggtaggggaccaaaggcttcggaacccgttccgtaggtaaccgacggacccgaacgggcctccggcccccttacggtccc

SEQ ID NO: 333080 - DNA, 538 bp, Homo sapiens
  misc_feature: GZ8MTXP02F61I9.15.59.F04.1.454.CMB.2.raw
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (398)..(398): a, c, t, g, unknown or other
  misc_feature (398)..(398): n is a, c, g, or t
  modified_base (508)..(508): a, c, t, g, unknown or other
  misc_feature (508)..(508): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtcccctgatcgcttctctggctccatcctggaaacaaagctgccctnaccccatcacggggcccaggcagntgatgaatctgtttatattgtgtcctatatatgggttnctggctagtttcggtctttacgggcggaaggggacccaaggtctggaaccgtccctagggtcacggcccaaggctcgccccctggtccactcgtcgttccccaccctccncgctaacgtagacctgacgcgggctggacg

SEQ ID NO: 333081 - DNA, 521 bp, Homo sapiens
  misc_feature: GZ8MTXP02F51WP.15.59.F04.1.454.CMB.2.raw
  modified_base (364)..(364): a, c, t, g, unknown or other
  misc_feature (364)..(364): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
  modified_base (518)..(518): a, c, t, g, unknown or other
  misc_feature (518)..(518): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcaacaaacactcgctcttctggggtcccctgatcgctttctctggctccatccttaggaaacaaagctgccctcaccccatcacggggcccaggcagntgatgaatctagtttatattgtgtctatatatgggtnctggctattcggtnttcggcggaggacccaagctagaccgtctaggtcagcccaaggctcgccccctcggtcactctcgttccccaccctcctcgctaacgtacgactgagcgggcngcg

SEQ ID NO: 333082 - DNA, 536 bp, Homo sapiens
  misc_feature: GZ8MTXP02GTRAD.15.59.F04.1.454.CMB.2.raw
  modified_base (368)..(368): a, c, t, g, unknown or other
  misc_feature (368)..(368): n is a, c, g, or t
  modified_base (407)..(407): a, c, t, g, unknown or other
  misc_feature (407)..(407): n is a, c, g, or t
  modified_base (497)..(497): a, c, t, g, unknown or other
  misc_feature (497)..(497): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttcgtcggggtcccctgactcgcttctctggctccatcctaggaaacaaagctcgccctcaccccagtccgacggggcccaggcagntgatgaatctagtttattattgtgttctatatagtggtncgtggctagtttcgtcgttcgggcggtaggaccaagcgtcgaccgtcgtaggtcacgaccgagcctcgcccctcggtcactctcgtcccnccctcctcgctaacgtacgactcgacgcggcgtcggacg

SEQ ID NO: 333083 - DNA, 526 bp, Homo sapiens
  misc_feature: GZ8MTXP02HPP87.15.59.F04.1.454.CMB.2.raw
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggcccagcctccacgcacgctcatcatagcacaaacactcgctctctggggtccctgactcgcttctctggctccatccttggaaacaaagctgccctcaccatcacgggggcccaggcagatgatgaatcttgtttattatttgttgtcttatatagtgggtgctggctagtttcggtcttcggcgggtaggaccaaggctcgaccgtcctaggtcgacgcccgaaggcctcgccccctggtccc

SEQ ID NO: 333084 - DNA, 565 bp, Homo sapiens
  misc_feature: GZ8MTXP02JNRL3.15.59.F04.1.454.CMB.2.raw
  modified_base (255)..(255): a, c, t, g, unknown or other
  misc_feature (255)..(255): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcacactcacttgnggcttgagctctggctcggtctctactcctactacccagctggtaccaacacgaccccaggccagcctccacgcacgctcatctatagcacaaaccactcgctcttcgtggggtccctgactcgtcttctctcggctccgatccttaggaaacaacgctcgccctcaccacgtcgaccggggcccaggctagatcgatacgtaatcgttagtttaattgtgttacgttacctatattacgtgggtgtcgtggtcttcgtttccggtcgttcgggaacggtacgggacacgtcgtcgtaaccgtcgtacgg

SEQ ID NO: 333085 - DNA, 533 bp, Homo sapiens
  misc_feature: GZ8MTXP02JPSH8.15.59.F04.1.454.CMB.2.raw
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (438)..(438): a, c, t, g, unknown or other
  misc_feature (438)..(438): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcctactacccagctggtaccaacacgaccccaggccagcctccacgcacgctcatctatagcacaaacactcgctctctggggtccctgactcgcttcnctggctccntccttaggaaacaagctcgccctcaccatcgacggggccaggcagactgatgatctgttattattgtgtctatatagtgggtncgtggctagtttcggtcgttcgggacgggtagggaccaacggctacgaccgttcgaggtccgacgacccaacgggcctccggccccctcggtccc

SEQ ID NO: 333086 - DNA, 571 bp, Homo sapiens
  misc_feature: GZ8MTXP02JTGT9.15.59.F04.1.454.CMB.2.raw
  modified_base (262)..(262): a, c, t, g, unknown or other
  misc_feature (262)..(262): n is a, c, g, or t
  modified_base (360)..(360): a, c, t, g, unknown or other
  misc_feature (360)..(360): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttctaaaaccccngctggtaccaacacgaccccaggccagcctccacgcacgctcatctatagcacaaacactcgctcttcgtcggggtccctgactcgcttctctgctcntcctaggaaacaagctcgccctcacccatccgaccgggggcccagggcagatgatgaatcttagtttattattgtgtctatatagtgggtgtcgtggctagtttcggtcgttccggggtacgggacggggacccaaaggccgtcgaaccccggttccgtaacgggtccaacggaccccgaacgggccctcccggccccccgttcggtcccc

SEQ ID NO: 333087 - DNA, 522 bp, Homo sapiens
  misc_feature: GZ8MTXP02HQIT7.15.59.F04.1.454.CMB.2.raw
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggcccagccctccacgcacgctcatcatagcacaaacactcgctctctggggtccctaatccgcttctctgctccatccttagaaacaaagctcgccctcaccatcgacggggcccaggcagatgatgaatctgtttattattgtgttctatatatggtgctggctatttcggtcttcggcggagggaccaagctacgaccgtcctaggtcaagcccaaggcctcgccccctcggtctaccg

SEQ ID NO: 333088 - DNA, 520 bp, Homo sapiens
  misc_feature: GZ8MTXP02HKHY5.15.59.F04.1.454.CMB.2.raw
  modified_base (360)..(360): a, c, t, g, unknown or other
  misc_feature (360)..(360): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatcccttggaaacaaagctgccctcaccccatcacggggcccaggcagntgatgaatctgtttattatgtgtcctatatatgggtgctggctatttcggtctttcgggcggagggacctaagctgaccgtctaggtcagccaaggctcgcccccgtcggtcactctcgttcccgccctcctccgctaacgtagactgagcggctggacg

SEQ ID NO: 333089 - DNA, 555 bp, Homo sapiens
  misc_feature: GZ8MTXP02ISFKY.15.59.F04.1.454.CMB.2.raw
  modified_base (362)..(362): a, c, t, g, unknown or other
  misc_feature (362)..(362): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgccacgctcatctatagcacaaacactcgctcttctcgggtccctgatcgctctctgctccatccttaggaaacaaagctcgccctcacccatccgacggggccaggcagntgatgaattctagtttattattgtgtctatagtagtggtgtcgtggctagtttcggtcttcgggcggtagggacctaagctcgaccgtcgtaggtcacgcccgaaggcctccgcccccgtcggtccacgttcctccgttccccaccccgtccctccgaccgtaacgtacgacgtcgacggccggcgtcggacg

SEQ ID NO: 333090 - DNA, 664 bp, Homo sapiens
  misc_feature: GZ8MTXP02I7J3P.15.59.F04.1.454.CMB.2.raw
  modified_base (276)..(276): a, c, t, g, unknown or other
  misc_feature (276)..(276): n is a, c, g, or t
  modified_base (372)..(372): a, c, t, g, unknown or other
  misc_feature (372)..(372): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttactacccagctgtaccaacacgaccccaggccagccctccacgcacgctcatctatagcaacaaacnctcgctcttcgtcgggtccctgactcgtcttctctggcctccattcctaggaaacaacgctcgccctcaccccagtccgaccggggccaggccagntgatgtaacttcttagttttacttagttcgttcgttacctattagttaggttggggtgtcgttaggtctttacgtttccgggttcgttaccggggacggtacgggtaaccctaaggtccgttacgggtaaccccgttccgtaacgggtccaaccgggtacccgtaaacgggtcccgttacccggtccccccgttcgggttaccctacccgttcccgttcccgttcccccgtccccttccgtccgtaccgttaaccggtacgtaccgtcggacggtccggtccgtggaaccgg

SEQ ID NO: 333091 - DNA, 618 bp, Homo sapiens
  misc_feature: GZ8MTXP02JW4PT.15.59.F04.1.454.CMB.2.raw
  modified_base (227)..(227): a, c, t, g, unknown or other
  misc_feature (227)..(227): n is a, c, g, or t
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaanagaccccaggccagccctcacgcacgctcgatcctatagcacaaacnctcgctcttcnggggtcccctgactcgcttcnctggctccatccttaggaaactaaggctagcctnacccagtcaacggggcccaggcagtntgactgaactctggtttaactagttgtgtaccctagtactagtcggtatcgttggctagtttcggtacttacgggcggtagggtaccctaaaggtccgttacggtaccgttaccgttaggtacctacggtccctaaagggtccctttacggcccccgtttacggtctaaaccgttccgttacgttcccgaacccgttcgtaccgtacttaacggtacgtacgttacggacgtaccggtcgtacggtaaccgg

SEQ ID NO: 333092 - DNA, 546 bp, Homo sapiens
  misc_feature: GZ8MTXP02G66XO.15.59.F04.1.454.CMB.2.raw
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
  modified_base (458)..(458): a, c, t, g, unknown or other
  misc_feature (458)..(458): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtacaaacacgaccccaggcccagccctccacgccacgctcatctatanacaacaaaacactcgctcttcgtggggtccctgactcgcttctctgctccntccttaggaaacaaagctcgccctacacccagtaccgaccgggggcccaggccagatgatgaatcttagtttattattgtgtctatatagtggntctggctagtttcggcttcgggcggaggaccaaggtcgtcgacccgtcgtaaggtcacgaccccgaggccctcgcccccgtggtaccc

SEQ ID NO: 333093 - DNA, 513 bp, Homo sapiens
  misc_feature: GZ8MTXP02IG97E.15.59.F04.1.454.CMB.2.raw
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (455)..(455): a, c, t, g, unknown or other
  misc_feature (455)..(455): n is a, c, g, or t
  modified_base (497)..(497): a, c, t, g, unknown or other
  misc_feature (497)..(497): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtcccctgatcgcttctctggctccatccttggaaacaaagctgccctcaccccatccacggggcccaggcagntgatgatctgtttattatntgtcctatatatgggtnctggctatttcggtcttcgggcggagggaccaagctgaccgtctagtcagccaagcncgcccctcgtcactctcgttcccgccctcctcgcctaacgtnactcgagcggctgacg

SEQ ID NO: 333094 - DNA, 532 bp, Homo sapiens
  misc_feature: GZ8MTXP02HYX4E.15.59.F04.1.454.CMB.2.raw
  modified_base (358)..(358): a, c, t, g, unknown or other
  misc_feature (358)..(358): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggcccagcctccacgccacgctcatctatagcaacaaacactcgctctctggggtccctgactcgcttctctgctcntccttagaaacaagctcgccctcaccatccgacggggcccaggcagatgatgaatcttagtttattattgtgtcctatatagtggtgcgtgtctagtttcggtcttcgggcggtacgggaccaaaggctcgacccgtctaggtcgacgacccgaaggctccgcccctcggtccc

SEQ ID NO: 333095 - DNA, 526 bp, Homo sapiens
  misc_feature: GZ8MTXP02HVEHE.15.59.F04.1.454.CMB.2.raw
  modified_base (358)..(358): a, c, t, g, unknown or other
  misc_feature (358)..(358): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaaacactcgctcttctggggtcccctgactcgcttctctggctcntccttaggaaactaagctcgccctcaccatcgacgggggcccaggcagatgatgatctgtttattattgtgtctatatagtggtgtctggctagtttcggtctttcggcggtacgggaccaagctcgaccgtcctaggtcgacgccacggcctcgccccctcggtccc

SEQ ID NO: 333096 - DNA, 539 bp, Homo sapiens
  misc_feature: GZ8MTXP02HCP2I.15.59.F04.1.454.CMB.2.raw
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (384)..(384): a, c, t, g, unknown or other
  misc_feature (384)..(384): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacactcactcttcgtcggggtccctgactcgcttcnctgctcntcctaggaaacaagctcgccctcaccntaccgacggggcccagcagagtgatgaattctagtttattatgttgtctatatagtggtgctgcttagtttcggtcgttcgggcggtaagggaccctaaagctacggaccgttccgtacggtcgacgacccgacgccgtccgtcccccgtgtccc

SEQ ID NO: 333097 - DNA, 559 bp, Homo sapiens
  misc_feature: GZ8MTXP02GH7HI.15.59.F04.1.454.CMB.2.raw
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctggacggaccgtcacactcacttgtggcttgagctctggctcggtctctactccttactaccccagctggtaccaacacgaccccaggccagccctccacgcacgctcatctatagcaacaaacnctcacttctcgtcggggtccctgactcgtcttctctgctcntcctaggaaacaagctcgccctcaccataccgaccggggccaggcagctgactagaatcttagtttattagttgtgttacctattactagtgggtgtcgtggtctagtttcggtcgttcggggcggtacgggaccaagccgtacgaccgtccgtaaggtcgacgacccgaacgggtcctccggtcccccgttacggtccc

SEQ ID NO: 333098 - DNA, 531 bp, Homo sapiens
  misc_feature: GZ8MTXP02FOFRF.15.59.F04.1.454.CMB.2.raw
  modified_base (479)..(479): a, c, t, g, unknown or other
  misc_feature (479)..(479): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactaccccagctggtaccaacagaccccaggccagcctccacgcacgctcatctatagcacaaaccactcgctcttctggggtccctgactcgcttctctggctccatccttaggaaacaagctgccctcaccatcgacggggcccaggcagatgatgaatcgtagtttatagttgtcgtactatatagtgggtncgtagctagtttcggtcgttcggcggacggaccagctacgaccgtcgtacgg

SEQ ID NO: 333099 - DNA, 577 bp, Homo sapiens
  misc_feature: GZ8MTXP02GUN35.15.59.F04.1.454.CMB.2.raw
  modified_base (318)..(318): a, c, t, g, unknown or other
  misc_feature (318)..(318): n is a, c, g, or t
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggaccgtcacactcacttgtggcttgagctctggctcggtctctactcctactacccagctgtaccaacacgacccaggccacgcctccacgcacgctcatctatagacacaaacnctcgctcttcgtcggggtcctgactcgcttctctcggctccntcctaggaaaccaagtcctcgccctcaccagtccgacgggggcccaggcagactgatagtattcttagtttattattcgttntaccttatagtagttgggtgtcgtggtacttcgtttcggtcgttccggggcgggtacggacccgtaaggtccgtacgtacccgtccgtacggtcgaccgtacccgacgggcccttcccggcccccgttcggtccc

SEQ ID NO: 333100 - DNA, 527 bp, Homo sapiens
  misc_feature: GZ8MTXP02F12BC.15.59.F04.1.454.CMB.2.raw
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
  modified_base (464)..(464): a, c, t, g, unknown or other
  misc_feature (464)..(464): n is a, c, g, or t
  modified_base (478)..(478): a, c, t, g, unknown or other
  misc_feature (478)..(478): n is a, c, g, or t
  modified_base (512)..(512): a, c, t, g, unknown or other
  misc_feature (512)..(512): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtccccctgggagggaccgtcacactcacttgtggcttgagctctggctcggtctctactcctactaccccagctggtaccaacagacccccaggccagcctccacgcacgctcatctatagcaacaaaccactcgctcttcgtcggggtccctgactcgcttctctgcctccatcccttagaaacaaagctcgccctcaccntcgaccggggcccaggcagangatgaatctgttatattgntactatatatggtnctggactgttcgtcgttcggcggacggacacgcncggaccgtccgtagg

SEQ ID NO: 333101 - DNA, 527 bp, Homo sapiens
  misc_feature: GZ8MTXP02F1A5V.15.59.F04.1.454.CMB.2.raw
  modified_base (359)..(359): a, c, t, g, unknown or other
  misc_feature (359)..(359): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
  modified_base (448)..(448): a, c, t, g, unknown or other
  misc_feature (448)..(448): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccacgcctccacgcacgctcatctatagcacaaacactcgctctcgtggggtccctgactcgcttctctggcctcntccttaggaaaacaaagctacgccctacaccatccgacggggcccaggcagntgatgaatntagtttatattgtgtctatatagtggtntcgtggctagtttcggtcttcgggcggagggacaagcgtcgaccgtctaggtcacgccgtacgcctcgccccctggtcc

SEQ ID NO: 333102 - DNA, 620 bp, Homo sapiens
  misc_feature: GZ8MTXP02I0D9A.15.59.F04.1.454.CMB.2.raw
  modified_base (277)..(277): a, c, t, g, unknown or other
  misc_feature (277)..(277): n is a, c, g, or t
  modified_base (370)..(370): a, c, t, g, unknown or other
  misc_feature (370)..(370): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacnctcgctcttcgtcggggtcccctgactcgtcttctctgctccatcccttaggaaacaagctcgccctcacccatccgacggggcccaggcagntgatgaattcttagtttattattgtgttactatatagtgggtgtcgtggtcttagtttcggtcgtttcggggacgggtaacgggaccctaaggccgtacggtaccccgttccgtacgggtaccacggaccccgaacgggtcctccggtccccccgttcggtccctaccgttcccgtccgtttcccccaccccttcccgtaccgtaccgttaacggtaccggtacgtcggacggtcgggcgtcgggaaccg

SEQ ID NO: 333103 - DNA, 582 bp, Homo sapiens
  misc_feature: GZ8MTXP02IIK8Z.15.59.F04.1.454.CMB.2.raw
  modified_base (267)..(267): a, c, t, g, unknown or other
  misc_feature (267)..(267): n is a, c, g, or t
  modified_base (311)..(311): a, c, t, g, unknown or other
  misc_feature (311)..(311): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtcccctgggagggaccgtcacactcacttgtggcttgagctctggctcggtctctactccttactacccagctggtaccaacacgaccccaggccacgcctccacgcacgctcatctanagcaacaaacactcgctcttcgtcggggtccctgactcgcttcnctgctccattctaggaaaacaaagcctcgccctacaccccacgtccgacggggccaggcaagntgatgaatcttagtttattatgtntactatatgtggtncgtgtctagtttcggtcgttcgggacggtaacgggacaagcgtacggaccgtcgtaggtcacgcccgaaggtccgtaccgcccccgttcggtccctaccgttccttcccgttcccccgtccctcccgtccgtactaaccggtacgacgtcggacggtcgggcgtcggacg

SEQ ID NO: 333104 - DNA, 552 bp, Homo sapiens
  misc_feature: GZ8MTXP02IOJNY.15.59.F04.1.454.CMB.2.raw
  modified_base (344)..(344): a, c, t, g, unknown or other
  misc_feature (344)..(344): n is a, c, g, or t
  modified_base (385)..(385): a, c, t, g, unknown or other
  misc_feature (385)..(385): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacccgtcacactcacttgtggcttgagctctggctcggtctctactccttactaccccagcctggtaccaacagaccccaggccagccctccacgcacgctcatctatancacaaaccactcgctcttctcggggtccctgactcgcttcnctggctccatccttgaaacaaagctgccctcaccatccgacggggcccaggccagactgatgaatcttgttattagttgtgttacctattatagttggggtgccgttggctagtttcggtcgtttcgggcggtacgggaccaacgccgtacggtaccgtactacggg

SEQ ID NO: 333105 - DNA, 582 bp, Homo sapiens
  misc_feature: GZ8MTXP02G14Z1.15.59.F04.1.454.CMB.2.raw
  modified_base (282)..(282): a, c, t, g, unknown or other
  misc_feature (282)..(282): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggcccagccctccacgccacgctcatctatagcacaaacactcnctcttcgtggggtccctgatcgcttctctgctcatccttaggaaacaaagcctcgccctcaccccacgtccgacggggcccaggccagctgatgaattcttagtttattattgtgtactatatagtggtgtcgtgtctagttcgtcgttcgggcggacggtacagtcgtacggtaccgtccgtacggtcgacgtcccgaacgtccgtccgcccccgtacggtcctaccttccgtccgttcccccacccttcccgtccgtcctaaccgtacgtacgtcggacggccggtcgtacggaccgg

SEQ ID NO: 333106 - DNA, 553 bp, Homo sapiens
  misc_feature: GZ8MTXP02FQUX3.15.59.F04.1.454.CMB.2.raw
  modified_base (357)..(357): a, c, t, g, unknown or other
  misc_feature (357)..(357): n is a, c, g, or t
  modified_base (460)..(460): a, c, t, g, unknown or other
  misc_feature (460)..(460): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtacccaacagaccccaggcccagccctccacgcacgctcactctatagcaacaaaacactcgcttcttcgtggggtccctgactcgcttcnctggctccatccttaggaaaacaagctacgcccctcaccatccgacgggggcccaggcagatgatgaaatcttagtttattattgtgtctagtatagtgggtnctggctagtttcgggcttcgggcgggtaaggaccaaagtcctcggaacccgtccttaggcacgaccaacggcctccgcccccgttcggtaccc

SEQ ID NO: 333107 - DNA, 568 bp, Homo sapiens
  misc_feature: GZ8MTXP02GDJKK.15.59.F04.1.454.CMB.2.raw
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagtctacgtagccacgaccggtgctcgatttagtacacacacttagggattgggggaaaaggccctgaggaaaacaaaccccagctgggaagcctgagaacacttagccttcatgagtcgtcccccaccatggcctggatgatgcttctcctcggactccttgcttatggatcgagggagtggtattctcagtactggtggtcgacccgaggacgccatcgttctcagtcgtccccgtgggacgggaccgtcacactcacttgtggcttgatctctgcgtcgtctctacctccttacctacccacgctcgtaccaacaccgacccgacgccncnccnccacgcncnctcatcgggggggggggtananacacaaccactcnctcttcgtcggtccgtcgtctctcttctctcgtctctctctacgaaacaacnctcgccnccacacgcgaccgggccgacgcgagatagagtagtatcttgtttattattgttgttactattagtagtggtgtcgtgtcgtcgttcggttcgtcggtcggacggacgacgcgtcgtaccgtcgtcg

SEQ ID NO: 333108 - DNA, 562 bp, Homo sapiens
  misc_feature: GZ8MTXP02JEIXZ.15.59.F04.1.454.CMB.2.raw
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggcccagccctccacgccacgctcatctatagcacaaacactcgctcttcgtcggggtccctgactcgcttctctggctccntcctaggaaacaagctcgccctcaccatccgaccggggccaggcagangatgatcgttagtttattattgtgttactattatagtgggtgcgtagtcttagtttcggtcgttcgggacgggacgggaccaaggtcctacggaacccgtccgtacggtccgaacggacccgaacggccgtccggcccccttcggtacccc

SEQ ID NO: 333109 - DNA, 658 bp, Homo sapiens
  misc_feature: GZ8MTXP02JJOFJ.15.59.F04.1.454.CMB.2.raw
  modified_base (312)..(312): a, c, t, g, unknown or other
  misc_feature (312)..(312): n is a, c, g, or t
  modified_base (365)..(365): a, c, t, g, unknown or other
  misc_feature (365)..(365): n is a, c, g, or t
  modified_base (426)..(426): a, c, t, g, unknown or other
  misc_feature (426)..(426): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcacactcacttgtggcttgagctctggctcggtctctactccttactacccagctgtaccaacacgaccccaggcccacgcctccacgccacgctcatctanagcaacaaacactcgctcttcgtcgggtccctgacctcgtcttctctgcctcnctccgtagaaacaagctcgccctcacctacgtccggaaccgggggcccaggacgaacgtanaggaactgtaaacttcgtttaggtttattttaagttcggtttacgtacctttaagttagttaggttggggttcgtcgttcgggtaccgttacggtttttccgggtcggtttaccgggggacgggttaacggggaacccgtaaggacccgttacggaaccccggttccgtacgggttaaccgaaccggtacccgtaacgggtccctcccgggtaccccccgttcggtaccccg

SEQ ID NO: 333110 - DNA, 527 bp, Homo sapiens
  misc_feature: GZ8MTXP02ISTSQ.15.59.F04.1.454.CMB.2.raw
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagtctacgtagccacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatatcacaacactcgctcttctggggtccctgactcgcttctctggcctccntccttggaaacaagctgccctcaccntcacgggggcccaggcagntgatgaatctgtttattattgttgtcctatatatgggtgctaggctagtttcggtctttcggcggagggaccaaaggcttcgaccgtcctaaggtccagccctaacggctcgccccctcggtaccc

SEQ ID NO: 333111 - DNA, 584 bp, Homo sapiens
  misc_feature: GZ8MTXP02JS70Z.15.59.F04.1.454.CMB.2.raw
  modified_base (275)..(275): a, c, t, g, unknown or other
  misc_feature (275)..(275): n is a, c, g, or t
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
  modified_base (406)..(406): a, c, t, g, unknown or other
  misc_feature (406)..(406): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacnctcgctctcgtcggggtccctgactcgcttctctgcctccatcccttaggaaacaagctcgccctnaccccatccgacggggccaggcagntgatgatcttagtttattattgtgtactatatagtgggtncgtggcttagtttcggtacgttcggggcggtaacgggaccagtcgtacggtacccgtccgtaagggtccacggcccgaaggtccctccgcccccgtcggtccaccgtccgttccgtacccctcccctcccgtccgtactaaccggtacgaacgtcggacggccgggtacgtcggaccg

SEQ ID NO: 333112 - DNA, 541 bp, Homo sapiens
  misc_feature: GZ8MTXP02GI1IE.15.59.F04.1.454.CMB.2.raw
  modified_base (362)..(362): a, c, t, g, unknown or other
  misc_feature (362)..(362): n is a, c, g, or t
  modified_base (451)..(451): a, c, t, g, unknown or other
  misc_feature (451)..(451): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttactaccccagctgtaccaacacgacccaggccagccctccacgcacgctcatctatagcacaaacactcgctcttcgtggggtccctggactcgcttctctggcctccntccttaggaaaacaaagctcgccctcaccactcgaccggggcccaggcagatgatgaatcttagtttatattgtgtctatatagtggtnctggctagtttcggtcttcggcgggaggacccgaagtcgtacgaccgttccgtaggtcgacgaccgtaacgcctcgccccctcggtaccc

SEQ ID NO: 333113 - DNA, 552 bp, Homo sapiens
  misc_feature: GZ8MTXP02HEX2Y.15.59.F04.1.454.CMB.2.raw
  modified_base (395)..(395): a, c, t, g, unknown or other
  misc_feature (395)..(395): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcacactcacttgtggcttgagctctggctcggtctctactccttactaccccagctggtaccaacacgaccccaggccagcctccacgcacgctcatctatagcacaaaccactcgctcttctcggggtccctgactcgcttctctcgctccntcctaggaaacaagctcgccctcaccacgtccgaccgggggcccaggccagactgatgtaatcgttagtttatattgtgttacctatattagtgggtgtcgtaggcttacgtttcggtcgttcgggcggtacggaccaggctacgtaccgtctacgg

SEQ ID NO: 333114 - DNA, 562 bp, Homo sapiens
  misc_feature: GZ8MTXP02I285E.15.59.F04.1.454.CMB.2.raw
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccacgcctccacgcacgcctcatctatacgcacaaacactcgctctcgtcgggtccctgactcgcttcnctgcctcntcctaggaaacaagctcgccctcacnctccgacggggcccaggcagatgatgaactcgttagtttattagttgtgtctagtatagtggttncgttacgcttagtttcggtacttcggggacggtacggaacccaaaggtcctacggacccgttcgtacggtccgaacggccccgtaagggccctcccggcccccgtttcggtccc

SEQ ID NO: 333115 - DNA, 539 bp, Homo sapiens
  misc_feature: GZ8MTXP02G3FY5.15.59.F04.1.454.CMB.2.raw
  modified_base (357)..(357): a, c, t, g, unknown or other
  misc_feature (357)..(357): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcaacaaacactcgctcttcgtggggtccctgactcgcttctctggctccntccttaggaaacaaagctcgccctcaccatccgacgggggcccaggcagactgatgaatctagtttattattgtgtctatatagtggtgcgtggctagtttcggtcgttcgggcggacgggaccaagcgtacgaccgtccgtaggtcgacgacccgaacggtcctccgcccccgtcggtccc

SEQ ID NO: 333116 - DNA, 549 bp, Homo sapiens
  misc_feature: GZ8MTXP02I3ONX.15.59.F04.1.454.CMB.2.raw
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
  modified_base (413)..(413): a, c, t, g, unknown or other
  misc_feature (413)..(413): n is a, c, g, or t
  modified_base (449)..(449): a, c, t, g, unknown or other
  misc_feature (449)..(449): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttactaccccagctggtaccaacacgaccccaggccagccctccacgcacgctcatctatagcacaaacactcgctcttctggggtccctgactcgcttctctgctcntccttaggaaacaagcctcgccctcaccntccgacgggggcccaggccagatganagaatcttagtttattattgtgtctatatagtggtncgtggtctagtttcgtcgttcgggacgggtacgggaccaaggctacggacccgttcgtaggtccgaacgcccgtaacggccgtccgcccccgtggtcccc

SEQ ID NO: 333117 - DNA, 602 bp, Homo sapiens
  misc_feature: GZ8MTXP02JDS6H.15.59.F04.1.454.CMB.2.raw
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggcccagccctccacgcacgctcatctatagcacaaacactcgctcttcgtggggtcccctgatcgtcttctctggctccatccttaggaaacaaagctcgccctcacccatcgacggggccaggcagntgatgattctgtttatattgtgtcctatatagtgggtncgtggtctagtttcggtcgtttcgggcggtaacgggtacccgaaggtcctggtaacccgtccgtaggtccacgacccgaaacgggtcctccgccccccgtcggttaccctaccgttccgtccggttccccctacccgttccccgtccgtacctaacggttaccgaacgttcggacggtccggggtcgttcgggaaccg

SEQ ID NO: 333118 - DNA, 552 bp, Homo sapiens
  misc_feature: GZ8MTXP02I4ETE.15.59.F04.1.454.CMB.2.raw
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaacagaccccaggccagccctccacgccacgctcatctatagcaacaaacactcgctcttctggggtccctgactcgcttcnctgcctccntcctaggaaacaagctgccctcaccatccgacgggggcccaggccagatgatgaatcttagtttatttattgttgttcctattatagtgggtgtctggctagtttcggtcgtttcgggcgggtacgggacccaaaggccttacgacccgttctaacgggtccgacgtcccgaaggcctccgcccccgttcggtccc

SEQ ID NO: 333119 - DNA, 561 bp, Homo sapiens
  misc_feature: GZ8MTXP02HO640.15.59.F04.1.454.CMB.2.raw
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (410)..(410): a, c, t, g, unknown or other
  misc_feature (410)..(410): n is a, c, g, or t
  modified_base (451)..(451): a, c, t, g, unknown or other
  misc_feature (451)..(451): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacctaccccagctggtaccaacacgaccccaggccagccctccacgcacgcctcatctatagcaacaaacactcgctcttcgtcggggtccctgactcgctttcnctgcctcntcctagaaacaagctcgccctcaccatccgacggggcccaggcagntgatgatctgtttattattgttgtccttatagtagtgggtncgtggactcgtttcgtcgttcgggacggtacgggacctaaggtctacggtacccgtcgtaacggtccgacgaccccgtaaacggtccgtccgtccccccgttacggtccc

SEQ ID NO: 333120 - DNA, 576 bp, Homo sapiens
  misc_feature: GZ8MTXP02HRH6A.15.59.F04.1.454.CMB.2.raw
  modified_base (360)..(360): a, c, t, g, unknown or other
  misc_feature (360)..(360): n is a, c, g, or t
  modified_base (459)..(459): a, c, t, g, unknown or other
  misc_feature (459)..(459): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggaccgtcacactcacttgtggcttgagctctggctcggtctctactccttactacccagctggaccaacacgaccccaggccagcctccacgcacgctcatctatagcaacaaacactcgctcttcgtggggtccctgacctcgcttctctgcctcncttcctagaaacacgctcgccctcaccatccggacggggcccaggcagatgatgtaatcgttagttttatttagttcgttgtcttaatattgtggggtntcgtggacttagtttcggtcgttcggggacggtacggggacctaaggccgttacgacccggttcgtacgggtaacaccggacccgtacggccttccccggcccccgttacgggtccc

SEQ ID NO: 333121 - DNA, 537 bp, Homo sapiens
  misc_feature: GZ8MTXP02IZZ8F.15.59.F04.1.454.CMB.2.raw
  modified_base (443)..(443): a, c, t, g, unknown or other
  misc_feature (443)..(443): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacactcgcttcttcgtcggggtccctgactccgtcttctctgcctccatccttaggaaacaacgctcgccctcaccatccgacggggcccaggcagatgatagattcttagtttatttattgttntctatatagtggtgcgtgctagtttcggtcgttacgggcggacggtacaagcgtcgaccgtcgtacggcacgccgacggctccgccctcgtccc

SEQ ID NO: 333122 - DNA, 581 bp, Homo sapiens
  misc_feature: GZ8MTXP02FTYOO.15.59.F04.1.454.CMB.2.raw
  modified_base (405)..(405): a, c, t, g, unknown or other
  misc_feature (405)..(405): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcaacaaacactcgctcttcgtggggtccctgactcgcttctctggctccatccttaggaaacaaagctgccctcacccatccgacggggcccaggcagatgatgaatcttagtttatattgtgtcctatatagtggtncgtggtctagtttcggtcgtttcggggcggagggaccaaggtctacggaacccgtccgtaggtccacggcccgaaggcctccggccccctcggtccaccttccttccgttccccctaccccttccctccgtaccgtaaccgtacgtaaccgtcggacggccggggtcacgggacgg

SEQ ID NO: 333123 - DNA, 593 bp, Homo sapiens
  misc_feature: GZ8MTXP02JAL6P.15.59.F04.1.454.CMB.2.raw
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactaccccagctggtaccaacacgaccccaggcccagccctccacgcacgctcatctatagcaacaaacactcgctcttcgtggggtccctgatcgcttctctggctccatccttaggaaacaaagctcgcccctcaccccatccgacgggggccccaggccagntgatgaatcttgtttattattgtgtcctatatagtggtncgtggctagtttcggtgtttccgggcgggtacgggacccaaggtcctacggacccgttctacgggtcacggacccgaaggccgtcgccccccgttcgggtccaccttccgttcgttcccccggtcccttcccgtccgtcccgttaacgtaacgtcgtacggcggtcgggccgtcggaccg

SEQ ID NO: 333124 - DNA, 612 bp, Homo sapiens
  misc_feature: GZ8MTXP02F8XBD.15.59.F04.1.454.CMB.2.raw
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (380)..(380): a, c, t, g, unknown or other
  misc_feature (380)..(380): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtcccctggagggaccttcacactcacttgtggcttgagctctggctcggtctctactccttactacccagctcggtaccaacacgaccccaggccacgccctccacgcacgctcatctanagcaacaaacnctcgctcttcgtcggggtccctgactcgtcttctctcggctccactcctaggaaacaaagcctcgcccctacaccccagtccggaacggggcccaggcagntgatagtaattctttagtttattattagttcgttacttattagtagtgggtcgtcgtggtacttagtttcggtcgttcggggacggtacgggaccgagtccgttacgacccgttccgtacggtccacggtacccgacggtccgtcccgtcccccgttcgtcctaccgttccttccgtacccctcctccgtacgtaccgtaacggtacgacgtcggacggtcggcgcggaacg

SEQ ID NO: 333125 - DNA, 551 bp, Homo sapiens
  misc_feature: GZ8MTXP02HBSZS.15.59.F04.1.454.CMB.2.raw
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggacgggaccgtcacactcacttgtggcttgagctctggctcggtctctactccttactaccccagctggtaccaacacgaccccaggccagcctccacgcacgctcatctatagcaacaaacactcgctcttcgtggggtccctgactcgcttcnctgctccntccttaggaaacaagctcgccctcaccatccgacggggcccaggcagatgatgaactcttagtttattagttgtgttaccttatattagtgggtgctggctagtttcggtcgtttcgggcggtaggggacccaaggcctacggacccgtcgtaagggtccacggaccccgaggtcctccggccccctcggtccc

SEQ ID NO: 333126 - DNA, 569 bp, Homo sapiens
  misc_feature: GZ8MTXP02G5N8G.15.59.F04.1.454.CMB.2.raw
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtccccgtgggacgggaccgtcaacactcacttggtggcttgagtctctggctcggtctctactccttactacccagctaggtaccaacacgaccccaggcccacgccctccacgcacgctcatcatacgcaacaaacnctcgctctcgtcgggccctgacctcgtcttcncgtgcctcnctcctaggaaacaagctcgccctacaccacncgaccggggccaggcagatgatagtaacttnttatttattgttcgttacttacttatagtgtggtgtcgtgtcttagttcggtcggtcgggacggacggaacacggtcgtaccgacccgttcgtacggaaccgaaccggtaccgacgtcccgtcccgtaccccgtcgtccc

SEQ ID NO: 333127 - DNA, 529 bp, Homo sapiens
  misc_feature: GZ8MTXP02JSDK6.15.59.F04.1.454.CMB.2.raw
  modified_base (305)..(305): a, c, t, g, unknown or other
  misc_feature (305)..(305): n is a, c, g, or t
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctggaggaccgtcacactcacttgtggcttgagctctggctcggtctctactcctactacccagctggtaccaacacgaccccaggccagccctccacgccacgctcatctanacgcaacaaacnctcgcttctcgtcggggtcctgactcgtcttctctgctcntcctaggaaacagcncgccctcaccntcggacggggccaggcagangatgatntgtttatagtgtntctatagtgtggtntcgtggcttagttcgtcgttcggggaggtacggaaccaggtccgtcgtaccgtcgtacggcgacgacccgaggccctcgtcccctggtaccc

SEQ ID NO: 333128 - DNA, 548 bp, Homo sapiens
  misc_feature: GZ8MTXP02JRZ5U.15.59.F04.1.454.CMB.2.raw
  modified_base (370)..(370): a, c, t, g, unknown or other
  misc_feature (370)..(370): n is a, c, g, or t
  modified_base (494)..(494): a, c, t, g, unknown or other
  misc_feature (494)..(494): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcctactaccccagctggtaccaacacgaccccaggccagccctccacgcacgctcatctatagcacaaacactcgctcttcgtggggtcccctgactcgcttctctggctccatccttaggaaacaaagctcgccctcaccccatccgaccggggcccaggccagntcgatgaatcttagtttattattgtgtactatatagtggtgcgtggtctagtttcggtcgttcggcggtaggaccaagctacggaccgtcgtacgtcacgccgaagcctccgcccctcggtacncgtctccgtccctccctccgtcgctaacgtacgacgtgacgcggactcggaccg

SEQ ID NO: 333129 - DNA, 632 bp, Homo sapiens
  misc_feature: GZ8MTXP02GR6WW.15.59.F04.1.454.CMB.2.raw
  modified_base (381)..(381): a, c, t, g, unknown or other
  misc_feature (381)..(381): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtcccctgggagggaccgtcacactcacttgtggcttgagctctggctcggtctctactccttactacccagctggtaccaacacgaccccaggccacgccctccacgccacgctcatctatagacaacaaacactcgcttcttcgtcgggtccctgactcgtcttctcgtcgcctccacttcctaggaaaacaagcctcgcccctcaccccagtccgaccggggccaggcagntgatagaattgttagtttattattgtcgttactatatagtggtgcgtgtctagtttcgtcgttcgggacggacggacagtcgtacggtaccgtacgtacggccgacgacccgaggtcccgtccggtcccccttacgggtccctaccgttcccgttcccggtttcccccgtcccccgttaccgtacccggttaccgtaaccggttacgtaaccggtcgggaccggggtccgggtaccgttacggggaaccgg

SEQ ID NO: 333130 - DNA, 566 bp, Homo sapiens
  misc_feature: GZ8MTXP02GOPPR.15.59.F04.1.454.CMB.2.raw
  modified_base (487)..(487): a, c, t, g, unknown or other
  misc_feature (487)..(487): n is a, c, g, or t
  modified_base (502)..(502): a, c, t, g, unknown or other
  misc_feature (502)..(502): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggacgggaccgtcacactcacttgtggcttgagctctggctcggtctctactccttactaccccagctggtaccaacacgaccccaggccagccctccacgcacgctcatctatagcaacaaaccactcgctcttcgtcggggtccctgactcgctttctctcggtctccatcccttaggaaaaccaagctcgccctacaccacgtaccgaccgggggccagggccaggactgatagaatcgttagtttattattgtntactatatagtggtncgtggtctacgttcggtcgttcgggaacggtacgggacctaggccgtacgtaccgttcgtacgg

SEQ ID NO: 333131 - DNA, 533 bp, Homo sapiens
  misc_feature: GZ8MTXP02H1PEK.15.59.F04.1.454.CMB.2.raw
  modified_base (358)..(358): a, c, t, g, unknown or other
  misc_feature (358)..(358): n is a, c, g, or t
  modified_base (440)..(440): a, c, t, g, unknown or other
  misc_feature (440)..(440): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcacaaacactcgctcttcgtggggtccctgactcgcttctctgctccntccttaggaaacaagctcgccctcaccatcgaccggggccaggtagatgatgatctgttattattgtgtctatatagtggtncgtgctagtttcgtcgttcggcggtaagggaccaagcgtacgaccgtcgtaaggtccaacgccccgaagcctccgcccccgtcggtcctaccg

SEQ ID NO: 333132 - DNA, 659 bp, Homo sapiens
  misc_feature: GZ8MTXP02F1QO5.15.59.F04.1.454.CMB.2.raw
  modified_base (368)..(368): a, c, t, g, unknown or other
  misc_feature (368)..(368): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcaacaaacactcgctcttctggggtcccctgatcgcttctctggctccatcccttaggaaacaaagctgcccctcaccccatccacggggcccaggccagntgactagtaatcgttagttttattagttgttcgtccttaataagttagtgggttcgcgttgggctttagtttccggttcggtttccggggacggggaacgggtaaccaagtccgtacggtaaccccgttaccgttacggtacgacccggacccgaaacgggtcctaccccggtcccccgttacggtcccttacccgttccttacccgttcccccctacccccttcccgttcccgtacccgttaaccggttacgaacccgttgggaaccgggtccgggcgtacggaaaccgg

SEQ ID NO: 333133 - DNA, 556 bp, Homo sapiens
  misc_feature: GZ8MTXP02FPCIJ.15.59.F04.1.454.CMB.2.raw
  modified_base (316)..(316): a, c, t, g, unknown or other
  misc_feature (316)..(316): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (402)..(402): a, c, t, g, unknown or other
  misc_feature (402)..(402): n is a, c, g, or t
  modified_base (519)..(519): a, c, t, g, unknown or other
  misc_feature (519)..(519): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacaccccagctgtaccaacacgaccccaggccagcctcacgcacgctcatctatagcacaaaacnctcgctctctggggtccctgactcgcttcnctggcctcntccgtaggaaacaagctcgccctcaccatcgacggggcccaggcagntgatgaatctgtttattattgtgtacctattatagtgggtgcgtggtctagtttcggcgtttcgggacgggtacggggaacccaaaggtccgtacgtacccgtccgtaaggtaaccncggaccccgaacggccttccgcccccgtcgggtcccc

SEQ ID NO: 333134 - DNA, 542 bp, Homo sapiens
  misc_feature: GZ8MTXP02INXSL.15.59.F04.1.454.CMB.2.raw
  modified_base (362)..(362): a, c, t, g, unknown or other
  misc_feature (362)..(362): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttactaccccagctggtaccaacacgaccccaggccacgccctccacgcacgctcatctatagcaacaaacactcgctctcgtcggggtccctgactcgcttctctgctccntccttaggaaacaagctcgccctcaccatccgacggggcccaggcagatgatgaatcttagtttattattgtgtacctatatagtgggtgcgtggcttagtttcggtcgttcgggcggacgggaccaagcgtcgaccgtctacggtccgacgacccgacggcctccgccccgtcggtccc

SEQ ID NO: 333135 - DNA, 586 bp, Homo sapiens
  misc_feature: GZ8MTXP02IK73O.15.59.F04.1.454.CMB.2.raw
  modified_base (255)..(255): a, c, t, g, unknown or other
  misc_feature (255)..(255): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtggtgacccaggagccatcgttctcagtcgtcccctgggagggaccgtcacactcacttgnggcttggagctcgtggctcggtctctactccttacctaccccagctcggtaaccaacacgacccccaggccacgccctccacgcaccgctcatctatagacaacaaaccactcgctcttcgtcggggttccctgtactcgtcttctctcgctccatcctaggaaacaagctcgccctcaccactccggaccggggcccaggcagatagatagaattcgttagtttattagttgtacgttaccttatagttaggtggggttgtcgttggacttacgtttccggttcgttcggggcggtaacgggacctaaggccgtcgtacccgtcgtacgg

SEQ ID NO: 333136 - DNA, 558 bp, Homo sapiens
  misc_feature: GZ8MTXP02G740O.15.59.F04.1.454.CMB.2.raw
  modified_base (367)..(367): a, c, t, g, unknown or other
  misc_feature (367)..(367): n is a, c, g, or t
  modified_base (471)..(471): a, c, t, g, unknown or other
  misc_feature (471)..(471): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggaccgtcacactcacttgtggcttgagctctggctcggtctctactcccttactaccccagctggtaccaacacgaccccaggcccagccctccacgcacgctcatctatagcaacaaacactcgcttcttcgtcggggtccctgactccgtcttctctggcctccntcctaggaaactaagctacgccctacaccagtccgacggggcccaggcagatcgatgaattcttagttttattagttgtcgttaccttatacgttagtcgggtntcgtggtacttgttcggtcttcgggcgggtaggaccaaggctacgaccctcgtaggcctacggaccacggcctccgccccgtgtccc

SEQ ID NO: 333137 - DNA, 628 bp, Homo sapiens
  misc_feature: GZ8MTXP02G1O44.15.59.F04.1.454.CMB.2.raw
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttactacccagctggtaccaacacgaccccaggccacgcctccacgccacgctcatctatagcaacaaacactcgctcttcgtcggggtcctgactcgtcttctctggcctctctcctaggaaaccaaagcctcgccctacaacctagtcccggacgggggcccaggcagactgatagaattcgttagtttatttagttcgttacgttaccttaattagttagttggggtcgtcgttggtactttagtttccgggttcgtttcgggggacggggtaacggtaccgtaaacgggtccgtccggtaacccgttccggttacggtccgtaacggaccccggaaacggtcccgtaccccgtccccccgttcggttaccccg

SEQ ID NO: 333138 - DNA, 582 bp, Homo sapiens
  misc_feature: GZ8MTXP02HB42Y.15.59.F04.1.454.CMB.2.raw
  modified_base (308)..(308): a, c, t, g, unknown or other
  misc_feature (308)..(308): n is a, c, g, or t
  modified_base (389)..(389): a, c, t, g, unknown or other
  misc_feature (389)..(389): n is a, c, g, or t
  modified_base (501)..(501): a, c, t, g, unknown or other
  misc_feature (501)..(501): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcacactcacttgtggcttgagctctggctcggtctctactccttactaccccagctggtaccaacngacccccaggccagccctccacgcacgctcatctatagcacaaaccactccgctcttcgtcggggtccctgactcgcttcnctgctccactccttaggaaacaacgctcgccctcaccacgtccgacgggggcccaggactagacgtgatagaatcgttagttatttattgtcttacgtatattagtcgggtntcgtggtacttacgtttcgggttccgtttcgggcgggtacgggaccgtaaacggtcgtacggtacccggtacgttaacggg

SEQ ID NO: 333139 - DNA, 559 bp, Homo sapiens
  misc_feature: GZ8MTXP02I2NKU.15.59.F04.1.454.CMB.2.raw
  modified_base (367)..(367): a, c, t, g, unknown or other
  misc_feature (367)..(367): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacacgaccccaggccagccctccacgcacgctcatctatagcaacaaacactcgcttctcgtcggggtccctgactcgtcttctctggcctccatccttaggaaacaagctcgcctcacccatcgacggggcccaggcagntgatagtattcttagtttattattgtcttcctatagtagtggtgtcgtgtctagtttcgtcgttcgggcggaggaccagctcgacccgtcgtagtcacgccgagcctcgccccgtcgtctaccttcctccgtcccctacccgtccgtccgtacgtaaccgtacgtacgtcggacggtccggcgtacggaccg

SEQ ID NO: 333140 - DNA, 588 bp, Homo sapiens
  misc_feature: GZ8MTXP02IUY3W.15.59.F04.1.454.CMB.2.raw
  modified_base (361)..(361): a, c, t, g, unknown or other
  misc_feature (361)..(361): n is a, c, g, or t
  modified_base (521)..(521): a, c, t, g, unknown or other
  misc_feature (521)..(521): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtggtgacccaggagccatcgttctcagtcgtcccctgggacgggaccgtcacactcacttgtggcttgagctctggctcggtctctactcctactaccccagctacgtaccaacacgacccccaggccacgccctccacgcaccgctcatctatacgcaacaaaccnctccgctcgttcgtcgggtccctgactcgtccttctcgtcgcctccacttccgtaggaaacaacgcctcgccctacaccacgtaccggaccggggcccagggcaagtagtgatagtaattcgttgtttaattagttgtcttactatagttagttcgggtncgttggctttacgtttcggcgttcggggaaccggtaggacctacgcgtacggtaccgttacgtacgg

SEQ ID NO: 333141 - DNA, 531 bp, Homo sapiens
  misc_feature: GZ8MTXP02HYAWW.15.59.F04.1.454.CMB.2.raw
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctgggaggaccgtcacactcacttgtggcttgagctctggctcggtctctactccttacctaccccagctgaccaacagaccccaggccagcctcacgcacgctcatctatagcaacaaaacactcgctcttcgtcggggtccctgactcgcttctctggcctcntccttaggaaacaagctcgccctcaccancgacggggcccaggcagatganagattnttattattntgtntactatatagtggtctgtcgtcttacgtttcggtcgttacgggacggacggacgagtcgtacgaccgtcgacgtccgacgaccgacgcctcccgccccgtcgtcc

SEQ ID NO: 333142 - DNA, 616 bp, Homo sapiens
  misc_feature: GZ8MTXP02GIETO.15.59.F04.1.454.CMB.2.raw
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
  modified_base (454)..(454): a, c, t, g, unknown or other
  misc_feature (454)..(454): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggcccagccctccacgcacgctcatctatagcaacaaacactcgcttctcgtggggtccctgctcgcttcnctgctcntcctaggaaacagcncgccctcaccntccgacgggggcccaggcagatgatcgaattcttagtttattagttgtgtcttaatacttagtgggtncgtggtcttacgtttcgggttacgttcgggggccgggtaacggggtaacccgtaaaggtcccggttacggtaaccccgttaccgttaacgggggtaaccctaaccggaacccccggtaaacggggtcccttacccgggtcccccccgtaggggtttaccccc

SEQ ID NO: 333143 - DNA, 549 bp, Homo sapiens
  misc_feature: GZ8MTXP02HYV4W.15.59.F04.1.454.CMB.2.raw
  modified_base (356)..(356): a, c, t, g, unknown or other
  misc_feature (356)..(356): n is a, c, g, or t
tcagtctacgtagccacgaccggtgctcgatttagtacacacacttagggattgggggaaaaggccctgaggaaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtccccctggagggaccgtcacactcacttgtggcttgagctctggctcggtctctactcccttactaccccagctggtaccaacacgaccccaggccagccctccacgcacgctcatctatagcaacaaaccnctcgctcttcgtcggggtccctgatcgcttctctgctcccatccttggaaacaagctcgccctcaccactccgacgggggcccagggcagactagatagaatctagtttattagttgttcgtctatatagtggtgctggtctacgtttcggtcttcgggcggacggaaccgacgcgtcggtaccgtcgtacgg

SEQ ID NO: 333144 - DNA, 667 bp, Homo sapiens
  misc_feature: GZ8MTXP02IPPTI.15.59.F04.1.454.CMB.2.raw
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttacacccngctgaccaacacgaccccaggccacgcctcacgcacgctcatctanacgacaacaaacnctcgctcttcgtcgggtccctgactcgtcttctcgtcggctccacttccgttaaggaaaactaaacgtctaccgcccctacgaaccccgacgtaccggaccgggggcccaagggacccaagacgtagaacttacggtaactttaccgtttagttttaaactttagttcgttacgtaccttaattaacgttaggttcggggtagtcgtggtcttaggtttcggttcgttcggggacgggtaacggtaccaagtcgtacggtacccgtcgtacggtacacgtacccgaacgggtcctacccggcccccgttacggtacctaccgttcccttaccgttccccctacccgttccgtccgtacgtaaccgtcgacgtcgaggtcccggatcggaacg

SEQ ID NO: 333145 - DNA, 542 bp, Homo sapiens
  misc_feature: GZ8MTXP02HN0NP.15.59.F04.1.454.CMB.2.raw
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
  modified_base (407)..(407): a, c, t, g, unknown or other
  misc_feature (407)..(407): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacacgaccccaggccacgcctccacgcacgctcatctatagcacaaacnctcgctctctggggtcctgacctcgcttctctggctccntccttagaaacaagctcgccctcaccatcgaccgggggcccaggcagangatgattcttgtttatttatttgttgttctattatagttgggtgcgtggtctagtttcggtcgttcgggtcgggacgggaccgagcgtcgaccgttccacggtcgacgacccacggcctccgccccgtcggtccc

SEQ ID NO: 333146 - DNA, 619 bp, Homo sapiens
  misc_feature: GZ8MTXP02JB7H9.15.59.F04.1.454.CMB.2.raw
  modified_base (375)..(375): a, c, t, g, unknown or other
  misc_feature (375)..(375): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgacccccaggccagccctccacgcacgctcatctatagcaacaaacactcgctcttctcggggtcccctgactcgctttctctcggctccgatcccttggaaactaaagctcgccctcacccactccgaccggggccaggcagntgatgaatctagtttatattgtgtctatagtagttcggtgcgtgcttagtttcggtcgtttcgggacgggtacgggtaacccaagtccgtcggtacccgtaccgttacggtcgaccgacccgtaaggtccgtcccgtcccccgtacggtacctacctccgttccgttaccccctccccttcccgtccggtaccttaaccggtacgttaacccgtaggacggacccggggtcgtcgggaacccgg

SEQ ID NO: 333147 - DNA, 532 bp, Homo sapiens
  misc_feature: GZ8MTXP02JHFB4.15.59.F04.1.454.CMB.2.raw
  modified_base (381)..(381): a, c, t, g, unknown or other
  misc_feature (381)..(381): n is a, c, g, or t
  modified_base (437)..(437): a, c, t, g, unknown or other
  misc_feature (437)..(437): n is a, c, g, or t
  modified_base (459)..(459): a, c, t, g, unknown or other
  misc_feature (459)..(459): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcctactaccccagctggtaccaacagaccccaggccagcctccacgcacgctcatctatagcacaaaccactcgctcttctcggggtccctgactcgcttcnctggctcatccttaggaaacaagctagccctcaccatcgacgggggcccaggcagntgatgaatctagtttatatgtntctatntagtggtngtggtctacgtttcggtcttcgggcggacgggaccaacggtctacgaccgtcgtaacgg

SEQ ID NO: 333148 - DNA, 538 bp, Homo sapiens
  misc_feature: GZ8MTXP02JIJEF.15.59.F04.1.454.CMB.2.raw
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (401)..(402): a, c, t, g, unknown or other
  misc_feature (401)..(402): n is a, c, g, or t
  modified_base (421)..(421): a, c, t, g, unknown or other
  misc_feature (421)..(421): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttacacccagctggtaccaacacgaccccaggccacgcctccacgcacgctcatcatagacacaaacactcgcttctcgtcgggtccctgactcgtcttctcgtcgctcntcctagaaacagctcncctcacntccgacggggccagcagnngatgatcttagtttaattnttgtcgttcctatacgtagtgggtctcgtgtcttacgtttcggtcgttacggcgggtaggacccagtcgtcgaccgtcgacggtcgacgacccgacggcctccgtccccgtggtccc

SEQ ID NO: 333149 - DNA, 548 bp, Homo sapiens
  misc_feature: GZ8MTXP02FR59J.15.59.F04.1.454.CMB.2.raw
  modified_base (356)..(356): a, c, t, g, unknown or other
  misc_feature (356)..(356): n is a, c, g, or t
  modified_base (405)..(405): a, c, t, g, unknown or other
  misc_feature (405)..(405): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccacgcctccacgcacgctcatctatagcacaaacactcgctcttcgtggggtccctgactcgcttctctgcctcntccttaggaaacaaagctgccctcaccactcgaccggggcccaggcagntgatgaatcttagtttattagttcgtgtaccttattatagttgggtctcgtggctagtttcggtcgttcgggcgggaagggaccaaaggctcgaccgtccgtaaggtcgacgaccgacggtcctaccgcccccgtcggtaccc

SEQ ID NO: 333150 - DNA, 567 bp, Homo sapiens
  misc_feature: GZ8MTXP02JAP7E.15.59.F04.1.454.CMB.2.raw
  modified_base (360)..(360): a, c, t, g, unknown or other
  misc_feature (360)..(360): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacactcgcttcttcgtcggggtccctgactcgcttctctcgcctcntcctaggaaacaagctacgcccctcaccatcccgacgggggcccaggccagactgatgaatcttagtttattattgttgtaccttattatagtgggtcgtcgtggtctacgtttcgggtccgtttcggggacgggacgggtaccaaaggtctacgtaccggtccgtaaggtccgacgacccgacggcctccgccccgttcggtaccc

SEQ ID NO: 333151 - DNA, 563 bp, Homo sapiens
  misc_feature: GZ8MTXP02JNTBI.15.59.F04.1.454.CMB.2.raw
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccacagaccccaggccagcctccacgcacgctcatctatagcaacaaaacactcgctcttctggggtccctgactcgcttcnctggctcntccttaggaaacaaagctcgccctacaccatccgaacgggggcccaggcagatgatgaatctgtttatattgtntctatatagtggtngtggactagtttcggtctttcggggcggtaacggggaccaaaggtccgtacgacccgttccgtaacgggttccaacggtaccccgaaacgggtccgtccgccccccgttcgggttccc

SEQ ID NO: 333152 - DNA, 567 bp, Homo sapiens
  misc_feature: GZ8MTXP02JONRC.15.59.F04.1.454.CMB.2.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (425)..(425): a, c, t, g, unknown or other
  misc_feature (425)..(425): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactccccagctggtaccaacacgaccccaggccagccctccacgcacgcncatcgtatagcaacaaacnctcgctctctggggtccctgactcgcttctctggttccatccgttagaaacaaacgctacgccctcacctacgccgaccgggggcccaggccagatggatgaaatttnttagtttattagttcgtacgttactatagtagtcggtcgtcgtagtcgttgtttcgtcgtacgggacggtacggacgacgtcgtacgtaccgtacgtacgacgaacgacccgtacggtccgtccgtccccgtcgtacctccg

SEQ ID NO: 333153 - DNA, 543 bp, Homo sapiens
  misc_feature: GZ8MTXP02FQRLH.15.59.F04.1.454.CMB.2.raw
  modified_base (363)..(363): a, c, t, g, unknown or other
  misc_feature (363)..(363): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagcctccacgcacgctcatctatagcaacaaacactcgctcttcgtggggtccctgactcgtcttctctggcctctntccttaggaaaacaaagcctcgccctcaccatccgaccgggggcccaggcacgatgatgaatctagtttattattgtgtctatatagtggtgtctggtctagtttcgtcgttcgggcgggaggaccaaggctcgaccgtcgtacggtcgacgaccgaacggcctccgccccgtcggtacc

SEQ ID NO: 333154 - DNA, 554 bp, Homo sapiens
  misc_feature: GZ8MTXP02JXQD3.15.59.F04.1.454.CMB.2.raw
  modified_base (394)..(394): a, c, t, g, unknown or other
  misc_feature (394)..(394): n is a, c, g, or t
  modified_base (494)..(494): a, c, t, g, unknown or other
  misc_feature (494)..(494): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtctccccggggggtgagggaccgtcacactcacttgtggcttgagctctggctcggtctctactccttactacccccagctggtaccaacacgacccccaggcccagccctccacgcacgctcatctatagcaacaaacccactcgctcttctcggggtccctgactcgcttcnctggctccatccttaggaaacaagctcgccctcaccatccgacgggggcccaggcagctagatgaatcttagtttattatgtgtacctatatagtgggtnctggctacgtttcggtcgttcgggcggtacgggaccacgtcgtcggtaccgtcgtaacgg

SEQ ID NO: 333155 - DNA, 527 bp, Homo sapiens
  misc_feature: GZ8MTXP02FO6VZ.15.59.F04.1.454.CMB.2.raw
  modified_base (360)..(360): a, c, t, g, unknown or other
  misc_feature (360)..(360): n is a, c, g, or t
  modified_base (397)..(397): a, c, t, g, unknown or other
  misc_feature (397)..(397): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtcccctgatcgcttctctggctccatcccttggaaacaaagctgccctcacccatcacggggccaggcagntgatgaatctgtttatattgtgtcctatatatgggtnctggctatttcggtcttcgggcggagggacccaagctgaccgtccgagtcagcccgaagcctcgccccctggtccactctcgttccccgccctcctcgcctaacgtacgacgtcgacgtcgggctggacg

SEQ ID NO: 333156 - DNA, 567 bp, Homo sapiens
  misc_feature: GZ8MTXP02JEOK5.15.59.F04.1.454.CMB.2.raw
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (421)..(421): a, c, t, g, unknown or other
  misc_feature (421)..(421): n is a, c, g, or t
  modified_base (499)..(499): a, c, t, g, unknown or other
  misc_feature (499)..(499): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcacactcacttgtggcttgagctctggctcggtctctactccttactaccccagcctggtaccaacacgacccccaggcccagcctccacgcacgctcatctananacaacaacccnctcgctcgttcgtcgggtcctgactctcttctcgtcgcctctactccgtaagaaacagctcnccctacacctacgccggaccgggccaggcagatgatagaattcttagtttattagttgtctactatagtacgtgggtntcgtggtcttacgtttcggtcgtcggggaacggtacggacctacggtccgtacggtaccgtacgtacg

SEQ ID NO: 333157 - DNA, 601 bp, Homo sapiens
  misc_feature: GZ8MTXP02G53I7.15.59.F04.1.454.CMB.2.raw
  modified_base (365)..(365): a, c, t, g, unknown or other
  misc_feature (365)..(365): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctggacgggaccgtcacactcacttgtggcttgagctctggctcggtctctactccttactaccccagctggtaccaacacgaccccaggcccacgccctccacgccacgctcatctatagcaacaaacactcgctcttcgtcggggtccctgactcgcttctctggcctccntccttaggaaacaagctacgccctacaccagtccggaccgggggcccaggccgaagtacgtgaacttacgaaacttcgttagtttatttagttcgttagttccttaattattaggttggggtcgtcgttggtacttcgtttcggtcgtttcgggacgggtaggaccgaacggtcgttaccgaccgttccgtaaggtccgacgacccggacgtccgtcccgcccccgttcggtaccc

SEQ ID NO: 333158 - DNA, 539 bp, Homo sapiens
  misc_feature: GZ8MTXP02GYA00.15.59.F04.1.454.CMB.2.raw
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagccctccacgcacgctcatctatagcacaaacactcgctctctggggtccctgatcgcttctctggctcatcctgaaacaaagctgccctcaccccatccgacggggcccaggcagctgatgaattctgtttattattgtgttcctatatacgtggtgctgctagtttcggtcttcggcggaggaccaagctcgaccgtccgtacgtcacgccgaaggctcgccccctcggtcctactccttcgtcccctacccgtccctcgccgtaacgtacgacgtcgacggcggcgtcggaacg

SEQ ID NO: 333159 - DNA, 558 bp, Homo sapiens
  misc_feature: GZ8MTXP02F4AL5.15.59.F04.1.454.CMB.2.raw
  modified_base (468)..(468): a, c, t, g, unknown or other
  misc_feature (468)..(468): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcccttactaccccagctggtaccaacacgaccccaggccacgccctccacgccacgctcatctatagcacaaaacactcgctcttctggggtccctgactcgcttctctggcctccatccttaggaaaactaaacgctacgccctcaccactcgaccgggggcccagggcagatgatagaaatcttagtttaattagtttgttgtcttaatatagtgggtncgtggctagtttcgtcgttcgggtcggagggtaccaaagcgtagacccgtcgtacgtccgacgacccaacggcctcgcccccgtggtccc

SEQ ID NO: 333160 - DNA, 620 bp, Homo sapiens
  misc_feature: GZ8MTXP02F9X1H.15.59.F04.1.454.CMB.2.raw
  modified_base (277)..(277): a, c, t, g, unknown or other
  misc_feature (277)..(277): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacnctcgcttctcgtcgggtccctgactcgtcttctcgtcggcctcctacgttcccgttaaggaaaaccaaacgcctacgccccctacacccctacgtcccggacgggggccccaggccagctgatagtaacttcttagtttattattgtcgtaccttatagttagtggtgcgttggtcttagttcggttcgttcggggcgggacggacgagcgtacggtaccgtccgtaggtcacgtccgaggccgtccgccccttcggtcctaccgtcccttccgttccccctacccgttcccgtcgttaccgtaacggttacgtacgttcgggacggccggtcgcgggaaccg

SEQ ID NO: 333161 - DNA, 543 bp, Homo sapiens
  misc_feature: GZ8MTXP02GHK5Q.15.59.F04.1.454.CMB.2.raw
  modified_base (360)..(360): a, c, t, g, unknown or other
  misc_feature (360)..(360): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctgggtccctgatcgcttctctggctccatccttggaaacaaagctgccctcaccccatccacggggcccaggcagntgatgaatctgtttattattgtgttctatatagtgggtgcgtggctagtttcggtcgtttcgggcggagggaccaagctaggaccgtccgtaggtcacgcccgaaggcctcgaccccctcggtccactccgtcgttccccgccctcccgtccgctaacgtcgacgtcggacgtcggctggacg

SEQ ID NO: 333162 - DNA, 609 bp, Homo sapiens
  misc_feature: GZ8MTXP02H6NKT.15.59.F04.1.454.CMB.2.raw
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (438)..(438): a, c, t, g, unknown or other
  misc_feature (438)..(438): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggaggacccgtcaacacctcacttgtggcttgagctctggctcggtctctactcctactacccagctgaccacacgacccaggccacgcctccacgccagctcatctagtancaacaaacactcgcctcttcgtccggggtcctagcctcgtcctttcncgttcggccttaccncttcccgttaagaaaactaaacgtcctacgccctacacccagccgaccgggggcccagggcaaggngtagatacgtacttacgttagtttatttagttgtttacgtacttatagtagttcggtctcgtcggtcttacggtttcgtcggttacgggacggtacggaccgtagtccgtaccgtcccgttacgtacggtaaccgaccgaccgtacgtcccgtacccgtccccgtcgtacc

SEQ ID NO: 333163 - DNA, 570 bp, Homo sapiens
  misc_feature: GZ8MTXP02HBTNF.15.59.F04.1.454.CMB.2.raw
  modified_base (494)..(494): a, c, t, g, unknown or other
  misc_feature (494)..(494): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggacgggaccgtcacactcacttgtggcttgagctctggctcggtctctactccttactaccccagcctggtaccaacacgaccccaggccacgcctccacgcacgctcatcctatacgcaacaaaccactcgctcttctcggggtccctggactcgcttctcgtggcctcctactccgttacggaaacaaacggcctcgcccctaccacctacgtccggaccgggggcccagggccagagtcgatgtaatcttagtttaatttnttcgtctactatagtcgtggtcgtcgtgtcttcgttcggtcgtcggcggacgacacgtcgtacgtaccgtacgacg

SEQ ID NO: 333164 - DNA, 565 bp, Homo sapiens
  misc_feature: GZ8MTXP02GZC38.15.59.F04.1.454.CMB.2.raw
  modified_base (218)..(218): a, c, t, g, unknown or other
  misc_feature (218)..(218): n is a, c, g, or t
  modified_base (332)..(332): a, c, t, g, unknown or other
  misc_feature (332)..(332): n is a, c, g, or t
  modified_base (364)..(364): a, c, t, g, unknown or other
  misc_feature (364)..(364): n is a, c, g, or t
  modified_base (471)..(471): a, c, t, g, unknown or other
  misc_feature (471)..(471): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgnggcttgagctctggctcggtctctactccttactaccccagctggtaccaacacgaccccacggccagccctccacgcaccgctcatctatagcaacaaacactcgctcttcgnggggtccctgactcgtcttctcgtcggctccntcccgttaggaaaacaaacgctacgccctacaccatccggaccggggcccaggacagatgaatgaaattcgttagtttaattattcgttctctaatatagtggggtntcgtgtctagttcgtcgtcgggacggaacggaccgagtcgtacgtaccgtcgtacggtaaccgacgaccgacgtccgtcccgtccccgtcgtcc

SEQ ID NO: 333165 - DNA, 608 bp, Homo sapiens
  misc_feature: GZ8MTXP02IEZS7.15.59.F04.1.454.CMB.2.raw
  modified_base (386)..(386): a, c, t, g, unknown or other
  misc_feature (386)..(386): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtggtgacccaggagccatccgttctcagtcgtccccgtgggagggaccgtcacactctacgttgtggtcttgagtctcgtggctcggtctcctactccttacctaccccagctacggtaaccaacaccgaccccacggcccacgccctaccacgaccaccgctctactctaactacgacaaaccaaaacccnctccgcttcgttcgtcggggtccctgactcgtcttctctcgctccattccgtaagaaacagctccgccctacaccacgtccggacgggacccaggcagatagatagaattcttagtttatagttgtacttctatatagtggggtctacgtcgtacgttacgtttcgggtcgttcgggaacgggtaacggaaccgacggtcgtaccgtaccgttcgtaaccgg

SEQ ID NO: 333166 - DNA, 641 bp, Homo sapiens
  misc_feature: GZ8MTXP02INW94.15.59.F04.1.454.CMB.2.raw
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtccccgtgggacgggaccgtcacactcacttgtggcttgagctctggctcggtctctactctacncccanctgaccaacacgacccaggccagcctcacgcacgctcatctanacacaacaaactactcgcttcgtcgtcgggtccctgactcgtctttctctcggtcctacctacttacccgtaggaaaaccaacgtcctcgcccctacaccccgacgtccggaccgggggacccaggaccgagatcgtaaatcgtaaatttcgtttagttttactttagttcgttacttaccttaagttagttagggtggtgtcggttacgtcgtttacgttcggttcgttacgggacgggtacggactacgcgtacggtaccgtacgtacggccacggaccgacgtccgtaccggtccctacggtcctccgtccgttcccgtcccgtcctaccgttcgtaccgtaacgtacgtacgtcggacggtccggtacgcggaacg

SEQ ID NO: 333167 - DNA, 611 bp, Homo sapiens
  misc_feature: GZ8MTXP02H0QBR.15.59.F04.1.454.CMB.2.raw
  modified_base (504)..(504): a, c, t, g, unknown or other
  misc_feature (504)..(504): n is a, c, g, or t
  modified_base (514)..(514): a, c, t, g, unknown or other
  misc_feature (514)..(514): n is a, c, g, or t
  modified_base (549)..(549): a, c, t, g, unknown or other
  misc_feature (549)..(549): n is a, c, g, or t
tcagtctacgtagccacgaccggtgctcgatttagtacacacacttagggattgggggaaaaggccctgaggaaaaacaaaccccagctgggaagcctgagaacacttagccttcatgagtgtccccaccatggcctggatgatgcttctcctcggactccttgcttatggatcaggagtggattctcagtactgtggtcgacccgaggacgccattcgttctcagtcgtccccgtgggacggaccgtcacacctctacgttggtggtcttggactctcgtggctcggtactccttactcccttacctaccccagtcctacggtaacccaaccgacgacccccgaggcccacggcccctcccacgccaccgcctactactactatacgacaacaaacccactcctctccttcgtccggggtccctgtactcgtccttctcgtcgactcctataccgttaggaaacaagtcgtaccgcctacactacgcggaccgggccagcagntgatgtaatnttagtttattagttgtacttctaagtgtagtggtntacgtggtacttgttccggtcgttggggaacgtacggacacgctccggtaccgtacgtacgg

SEQ ID NO: 333168 - DNA, 567 bp, Homo sapiens
  misc_feature: GZ8MTXP02FP5LW.15.59.F04.1.454.CMB.2.raw
  modified_base (323)..(323): a, c, t, g, unknown or other
  misc_feature (323)..(323): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (476)..(476): a, c, t, g, unknown or other
  misc_feature (476)..(476): n is a, c, g, or t
  modified_base (509)..(509): a, c, t, g, unknown or other
  misc_feature (509)..(509): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtggtgaccccagggacgccattcgttctcagtcgtcccctgggacgggaccgtcacactcacttgtggcttgagtctctggctcggtctctactcctacctaccccagctaggtaccaacacgaccccnggccagccctccacgcacgctcatcgtaanacacaacaaccnctcnctctcgtcggtcctgctcgtcttctcgtcgtcctactactaccgtaaagaaactacgtcctccgaccctcacacgccgggaccgggccaggcagagtgatagtattntttagtttattctgtctactagtagtgtcggtncgtgtacttcgttcgtcggtcgggaacggacgacgtacgtcgtacgtaccgtcgtacg

SEQ ID NO: 333169 - DNA, 630 bp, Homo sapiens
  misc_feature: GZ8MTXP02JVKVY.15.59.F04.1.454.CMB.2.raw
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggaccgtcacactcacttgtggcttgagctcgtggctcggtctcttacctcccttacctaccccagctggtaccaacacgacccccaggcccacgccctccacgccacgcncatctatagcaacaaacnctcgcttcttcgtcggggtccctgactccgcttctctggcctctctccttaggaaacaagcctcgcccctcaccagtcccggacccgggggcccaggcagatgtaagtagtacttcgtttagttttatttagtttcgtacgttaccttagttaagtagttcggggtcgtcgtaggtcctttacggtttcgggttcgttccgggggacgggaacgggacccgtaaggtccgttaccggacccgttccgtacggccgtaacggacccgtacggccgtaccccgtccccggtccggtaccc

SEQ ID NO: 333170 - DNA, 597 bp, Homo sapiens
  misc_feature: GZ8MTXP02H4O0Q.15.59.F04.1.454.CMB.2.raw
  modified_base (297)..(297): a, c, t, g, unknown or other
  misc_feature (297)..(297): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaagccacgcctccacacacgctcatctatagcaacaaacactcgctcttcgtgggtcccngtatcgcttctctcggctccatccgtagaaacaaagctcgccctccaccccacgtccgaccggggcccgagcctagatagatacgattcttagttttatttattgttgtaccttatagttagtggggttgtcttaggtcttaggtttccgtcgttacgggcgggaacggacgtaagcgtcgtaccgtccgtaggtacacgccgaacggctccgtaccccctcggtctcctcgtacccgttacccctccctcccgttgacccgttaaacgtcgaacgtcggcggccgggtacgtcggacgg

SEQ ID NO: 333171 - DNA, 577 bp, Homo sapiens
  misc_feature: GZ8MTXP02HSA4D.15.59.F04.1.454.CMB.2.raw
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggaccgtcacactcacttgtggcttgagctctggctcggtctctactccttacctacccngctggtaccaacacgaccccaggccacgcctcccacgcacgctcatctatagcaacaaacnctcgcttcttcgtcggggtccctgactcgcttcnctgcctcncttcctagaaacaagctcgccctcaccatccggacggggcccaggcagactgatgtattcttagtttatttatttgttcgttacttatagttagtggtgtcgtgcgtacgtttcggtcgttcgggacgggaggtaccgaacgcgtacgacccgttaccgtacggtaaccgacgacccgtaacggcccgtcccggcccccgttccgggtccc

SEQ ID NO: 333172 - DNA, 593 bp, Homo sapiens
  misc_feature: GZ8MTXP02FLYMJ.15.59.F04.1.454.CMB.2.raw
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
  modified_base (489)..(489): a, c, t, g, unknown or other
  misc_feature (489)..(489): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcccttactaccccagctggtaccaacacgaccccaggccagcctccacgcaccgcncatctatancaacaaacactcgcttcttcgtggggtcccctgacctcgtcttctcgtcggcctcctntaccgttaggaaaaccaacgtcctacggcccctcaacccgtatcccggacccgggggcccagggccaagactagatgaattcgttagtttattattgtacgtctatagtagtgggtcngttggcttagtttcggtcgttacggggcggacgggtaccaagtccgtacgtaccgtaccgttaggccgacggacccgacggtccgtaccgcccccgtggtaccc

SEQ ID NO: 333173 - DNA, 550 bp, Homo sapiens
  misc_feature: GZ8MTXP02FT990.15.59.F04.1.454.CMB.2.raw
  modified_base (358)..(358): a, c, t, g, unknown or other
  misc_feature (358)..(358): n is a, c, g, or t
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacaccccagctgtaccaacacgaccccaggccagccctccacgcacgctcatctaatagcaacaaacactcgcttcttcgtggggtcccctgactcgcttctctgcctcntctaggaaacaagctcgcctcaccatccgacggggcccaggcagactgatgaatcttagtttattattcggtnttacctagtatgtggtncgttggcttagtttcggtcgttcgggacggtacgggaccaaagtcgtacgaaccgtcgtacggtaacacggtaccaacgggcctccggtccccgtcgtaccc

SEQ ID NO: 333174 - DNA, 548 bp, Homo sapiens
  misc_feature: GZ8MTXP02GG2SR.15.59.F04.1.454.CMB.2.raw
  modified_base (361)..(361): a, c, t, g, unknown or other
  misc_feature (361)..(361): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacacgaccccaggccagccctccacgcacgctcatctatagcaacaaacactcgctctcgtggggtcccctgactcgcttctctgctccntcctagaaacaacgctacgccctcaccacgtcgaccgggggacccaggccagatgatgaattcttagttttattagttggttactaccttaattagtagtggtgtctaggctagtttcggtcgttcgggcggaggccaagcgtacgaccgtcgtagcgacgaccgacggcctccgccccgtcggtcc

SEQ ID NO: 333175 - DNA, 568 bp, Homo sapiens
  misc_feature: GZ8MTXP02HR8UP.15.59.F04.1.454.CMB.2.raw
  modified_base (264)..(264): a, c, t, g, unknown or other
  misc_feature (264)..(264): n is a, c, g, or t
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
  modified_base (523)..(523): a, c, t, g, unknown or other
  misc_feature (523)..(523): n is a, c, g, or t
tcagtctacgtagccacgaccggtgctcgatttagtacacacacttagggattggggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactaccccagctgtaccaacacgaccccaggccagcctccacgcacgctcatctanagcaacaaacactcgctcttcgtcggggtccctgactcgtcttcnctggctccatccttaggaaaacaaagctacgccctacaccccagtccgaccggggcccaggcagntgatgaatcttagtttaattattgtntaccttatatagtggtgtctgtctacgtttcggtcgttcgggcggagggaccaagcgtacgaccgtcgtaaggcaacgcccgaacggctccgcccccgtacggtccacctcctccttcccccnccctcctccgactaacgtagtacgtcggacggccggcgtacgacg

SEQ ID NO: 333176 - DNA, 574 bp, Homo sapiens
  misc_feature: GZ8MTXP02IWDIB.15.59.F04.1.454.CMB.2.raw
  modified_base (208)..(208): a, c, t, g, unknown or other
  misc_feature (208)..(208): n is a, c, g, or t
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
  modified_base (479)..(479): a, c, t, g, unknown or other
  misc_feature (479)..(479): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacctnacactcacttgtggcttgagctctggctcggtctctactccttacaccccagctgtaccaacacgaccccaggccacgccctccacgcacgctcatctatagcaacaaacactcgcttctcgtcgggcctgactcgtcttctcgtgccttccnttccgttaggaaaactaaagcctcgccctacaccacgtccggacccgggggccaggcaagntagatacgaaattcttagttttattattcggtttctacttagtaagtagtggggttntcgtgtcttacgtttcgtcgtcgggacggacgacgacgtcgtacgtaccgtacgtacgaaccgaccgacccgacgtccgtcccgtccccgtcgtc

SEQ ID NO: 333177 - DNA, 606 bp, Homo sapiens
  misc_feature: GZ8MTXP02F0SQC.15.59.F04.1.454.CMB.2.raw
  modified_base (375)..(375): a, c, t, g, unknown or other
  misc_feature (375)..(375): n is a, c, g, or t
  modified_base (447)..(447): a, c, t, g, unknown or other
  misc_feature (447)..(447): n is a, c, g, or t
  modified_base (534)..(534): a, c, t, g, unknown or other
  misc_feature (534)..(534): n is a, c, g, or t
  modified_base (566)..(566): a, c, t, g, unknown or other
  misc_feature (566)..(566): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccttcacactcacttgtggcttgagctctggctcggtctctactccttactaccccagctggtaccaacacgaccccaggccagccctccacgcacgctcatctatagcaacaaacactcgctcttcggtcgggtccctgatcgtctctctgcctccattcctagaaacaagcctcgccctacacccagtccggaccggggacccagggccaagntgatagtaaaccttgttagtttattacttgttacgtaccttaatagtagtggtgcgtgtacttgtttcccgngttacggggacggacgggactaacgtcttaccggaccgtcccgtaaggccgtacgacccgaagtccgtacccgcccccggtcgtccncctttccggtccgttccccgccctcccgttcncccgtaagtacgtaactcggaacggtcggtccgaggacgg

SEQ ID NO: 333178 - DNA, 557 bp, Homo sapiens
  misc_feature: GZ8MTXP02HI3D1.15.59.F04.1.454.CMB.2.raw
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (412)..(412): a, c, t, g, unknown or other
  misc_feature (412)..(412): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtgggacgggaccgtcacactcacttgtgcttgagctctggctcggtctctactcctacacccagctggtaccaacacgaccccagccagcctccacgcacgctcatctanagcaacaaacactcgcttcttcgtcggggtccctgactcgcttcnctgctccntccttaggaaacaagctcgccctcaccagtccgacgggggcccaggcagangatgtaatcttagtttacttattgtacgtcttatatgtgggtgcgtggctacgtttcggtcgttcggggccggtaggaaccctagtccgtacgacccgtcgtacggtcgaccggaccgacggtccctccgcccccgttggtaccc

SEQ ID NO: 333179 - DNA, 618 bp, Homo sapiens
  misc_feature: GZ8MTXP02FSLF4.15.59.F04.1.454.CMB.2.raw
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctgggacgggaccgtcacactcacttgtggcttgagctctggctcggtctctactccttacctaccccagctaggtaccaacacgacccccaggcccagccctaccacgccacgcncatctatagacacaaaccnctcgctcttcgtcggggtccctgatccgtcttcctcgtgcctccacttccgttaggaaaccaaacgcctcgcccctacacccacgtaccggaccgggggcccagggccaagagtagtatacggtaaacttcgttagttttaattatttcgttagttaccttaattagttacggttggggtcgtcgttcggtatacggttttcggtcgtttcggggaacggtacgggacctacggctcggtacccggtaccgtacggg

SEQ ID NO: 333180 - DNA, 715 bp, Homo sapiens
  misc_feature: GZ8MTXP02HCJ1T.15.59.F04.1.454.CMB.2.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (366)..(366): a, c, t, g, unknown or other
  misc_feature (366)..(366): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtggtcgacccaggacgccatcgttctcagtcgtccccgtgggacgggacctcacactcacttggtggtcttgagctcgtgctcggtctctactcctaccacccngctcgaccaacacgaccccnggccagccctccacgccaccgctcactctaatacgaccaacaaacccncctaccgtcctcgttccgtcggggtccctggtccttcggtcctttccgtcgtacggtcctacccgtacttacccgttaaagggaaaacctaacggtccctacccgtacccccttaccgaacccgtacgtacccggggaaccccgggggccccaaggggtacccaaggacttacgtaagttacgtaaagtttccgtttagtttttaattacgtttacggttaccgtttaccttaagttacggttagggttcggggttcgtaccggttggttaccgtttcggttcccgggttcggttacggggcggtaacgggacctacggtccgtaccggtacccgttacgtaacccggg

SEQ ID NO: 333181 - DNA, 647 bp, Homo sapiens
  misc_feature: GZ8MTXP02JFLYR.15.59.F04.1.454.CMB.2.raw
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (373)..(373): a, c, t, g, unknown or other
  misc_feature (373)..(373): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactggtggtgacccagggagccatcgttctcaggtcgtccccgtgggacgggaccgtcacactcacttgtggtcttgagctcgtggctcgtctctactcctacacccngctcgaccacacgacccagccacgccnccacgccacgctcatctatacgacaaactaaaccactccgtctcttcgtcggggtccctgtacctcgtcttctcgtcgcctccnttccgtaaggaaaacaacgtcctcgccctacacccgacgtacccggacccgggggcccaagggaccgtagtagtaggtaagtaacgttattacttttaggtttaaattttaggttcggttacttactttagtaagttcgggtgggtctaggtcgttacgttcgttttcgggcgtttcgggggacgggaaacggggacctaaggtccgtccggtaaccggtcgttaaggaacccgacggtaacccgtacggtcctccccggtccccgtcgtaccc

SEQ ID NO: 333182 - DNA, 568 bp, Homo sapiens
  misc_feature: GZ8MTXP02HYG7Z.15.59.F04.1.454.CMB.2.raw
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgccctttttggagggaccgtcacactcacttgtggcttgagctctggctcggtctcctactccttactaccccagctggtaccaacacgaccccacggccagccctccacgcacgctcatctaatagacaacaaaaccactcgctcttcgtcggggtccctgatcgcttctctcgctccatcccttaggaaaacaaagctcgccctacaccactccgaccgggggcccagggcaagatgatgaaattcgttagtttattattgttacgttacctaattaatagtgggttgcgtggctagtttcggtcgttcgggaacggacggaacaacgcgtacgaccgtctacgg

SEQ ID NO: 333183 - DNA, 610 bp, Homo sapiens
  misc_feature: GZ8MTXP02FLCYE.15.59.F04.1.454.CMB.2.raw
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaaccaacacgaccccaggccagcctccacgcacgctcatctatagcaacaaacactcgctcttcgtcgggtccctgatcgcttctctgctccatccttaggaaacaaagctgcccctcaccccacgtccgaccgggggcccaggcagctgatgaatctgtttattattgtgttcctattatagtggtgcgtggtcttacgtttcggtcgttcggggcggtaagggaccaaggtctacggaccgttccgtaaggtcgacgtacccgaacggtcctaccggtcccccgttcggtaccctaccgttcccgttccgttaaccccctaccccgttccctaccgtaccgttaaccgtacgacgttacggacggtccgggacgttcggaaccgg

SEQ ID NO: 333184 - DNA, 582 bp, Homo sapiens
  misc_feature: GZ8MTXP02JKEEC.15.59.F04.1.454.CMB.2.raw
  modified_base (316)..(316): a, c, t, g, unknown or other
  misc_feature (316)..(316): n is a, c, g, or t
tcagtctacgtagccacgaccggtgctcgatttagtacacacacttagggattgggggaaaaggccctgaggaaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcacactcacttgtggcttgagctcgtggctcggtctctactcctactaccccagctggtaccacacgaccccnggccagcctccacgcacgcctcatctatacgcaaccaaaccactcgctcttcgtcggggtccctgactcgctttctcgtcgctcctacttccgtagaaactagctacgccctcaccacgtccgaccgggggcccaggcacgatagagtagtaacttcttaggtttatttactgttcgtccttatactaggtcggtgtcgtggtcttacgtttcggttcgtacggtcgggaacggaccgacggtctacggtaaccgttccgtacggg

SEQ ID NO: 333185 - DNA, 644 bp, Homo sapiens
  misc_feature: GZ8MTXP02INEET.15.59.F04.1.454.CMB.2.raw
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
tcagtctacgtagccacgaccggtgctcgatttagtacacacacttagggattgggggaaaaggccctgaggaaaaacaaaccccagctgggaagcctgagaacacttagccttcatgagtgtccccaccatggcctggatgatgcttctcctcggactccttgcttatggatcaggagtggattctcagactgtggtgacccaggacgccatcgttctcagtcgtcccctgggacgggaccgtcacactcacttgtggcttganctctggctcggtctctactccttacacccngctgtaccacncgaccccaggcccagccctacccacgccaccgctcatctatacgcaacaacccactcgtactcgttcgtcggggtccctggtactccggtcttccgtccgtggcctccacttcccgttaggaaaaccaagtcctcgacccctcaaccctacgcccgaccgggggacccacgggaccaaggacttacgaagttgaaacttcgtttagtttatttagttcgttacgtccttaataagttgtggggtgtccgttaggtcgttacgtttccgggttcgttaccgggggcgggtaacggggtacccaaacggtccgtacggtaacccggttcccgtaaccggg

SEQ ID NO: 333186 - DNA, 672 bp, Homo sapiens
  misc_feature: GZ8MTXP02JDBAM.15.59.F04.1.454.CMB.2.raw
  modified_base (476)..(476): a, c, t, g, unknown or other
  misc_feature (476)..(476): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtgggacgggaccgtcacacctcacttggtggcttgagtctcgtggctcggtctctactccttactacccagctacggtaccaacacgaccccaggccacgccctccacgccacgctcatctatacgaccaacaaaactactccgacttccgttccggtcggggtcccctagacctcgtccttctcctaggcccttaccgtactaccgttaaggaaaaacctaaacgccttaccgcccctacaaccctacgaccggacccgggggcccagggacaagtnagatagaaacttcgtttagttttaattagtttagtacttacttaattagtaagtcgggtgtcgtgtacttacggttttccggacgtttccggggacgggaacggaacccgtaaagtccgttacgtaaacccggtttccgaaacgggtcaaacccggacccgaacggtccctacccgggtacccccctggttacccc

SEQ ID NO: 333187 - DNA, 598 bp, Homo sapiens
  misc_feature: GZ8MTXP02JIYFW.15.59.F04.1.454.CMB.2.raw
  modified_base (321)..(321): a, c, t, g, unknown or other
  misc_feature (321)..(321): n is a, c, g, or t
  modified_base (347)..(347): a, c, t, g, unknown or other
  misc_feature (347)..(347): n is a, c, g, or t
  modified_base (523)..(523): a, c, t, g, unknown or other
  misc_feature (523)..(523): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggacgggaccgtcacactcacttgtggcttgagctcgtggctcggtctctactcctactaccccagctagtaccaacacgaccccagccacnccctccacgcacgcctcatctagtanacaacaaacccactccgctccttcgtcggggtccctgactcgtcttccgtctggccttccacttccgttaggaaacaagcctccgccctccaacctacgtcccggaccgggggacccagggaccagatgatacgaatcttagtttattagttcgttgtacttatagttagtgggtncgtggtacttcggtttcggttaccgttggggaaccggtacggacccgtaaggtcctacggtacccgtacgtacgg

SEQ ID NO: 333188 - DNA, 701 bp, Homo sapiens
  misc_feature: GZ8MTXP02IMEAA.15.59.F04.1.454.CMB.2.raw
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (376)..(376): a, c, t, g, unknown or other
  misc_feature (376)..(376): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtcgacccgaggagccatcgttctcagtcgtccccgtgggacggacctcacactctacttggtggcttgagtctcgtggcttcggtcctctaccttcccttacctaccccagctcggaaccaacgaccgaaccccnggccacgcccctccacgccacgctctatctanacgcaacaaactctcgcttcgttcgtcgggtcctgtcctccgctttcncgtcgtcctacacgttcctaaggaaactaacgtcctcgaccctacacccgtagtcccggaccgggggacccaggacagtactgtaacgtagtaacttccgtttagttttaaacgtttcgttacggtttacttaccgttaagttacgttaggttggggttacgttcgtagggttccctttagggtttccgggtacggtttaccgggagggggtaaacggttaccaacgggtaccctaccgggtaaccccgtttacgccgggttaaaaccgccggtaaccccgttaacgggtcccttaccccgggtcccccgttaccggtttaaccc

SEQ ID NO: 333189 - DNA, 643 bp, Homo sapiens
  misc_feature: GZ8MTXP02HIS6U.15.59.F04.1.454.CMB.2.raw
  modified_base (212)..(212): a, c, t, g, unknown or other
  misc_feature (212)..(212): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagacttggtggtcgacccagggacnccattcgttctcaggttcgtcccctgggacgggaccctcactactctactttggtcggtcttaggacgtctcgtggctcggtctctacctccttacctaccccgagtctacggtaaccaacacgaccccaggcccagccctccacgcacgctcactctaatacgcaaacaaacccaccgtcgtccttcgtttccggtcggggttccctggtactccgtcttctcgtcggcttccagttccgtaagaaaccaagcctcgaccctccaccacgtaccgggacccgggggcccaagggctaggacttgagttacgaatttcgtttagtttagtttacgttgttacgtactattaagttaggtcggtagtcgttgtcgttacgtttcggtcgttacggcgggtacgaacgtacggtctacgaccggttcgtacgg

SEQ ID NO: 333190 - DNA, 598 bp, Homo sapiens
  misc_feature: GZ8MTXP02JX47R.15.59.F04.1.454.CMB.2.raw
  modified_base (280)..(280): a, c, t, g, unknown or other
  misc_feature (280)..(280): n is a, c, g, or t
  modified_base (325)..(325): a, c, t, g, unknown or other
  misc_feature (325)..(325): n is a, c, g, or t
  modified_base (372)..(372): a, c, t, g, unknown or other
  misc_feature (372)..(372): n is a, c, g, or t
  modified_base (504)..(504): a, c, t, g, unknown or other
  misc_feature (504)..(504): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctcgtggctcggtctctactccttacctacccagctggaccacacgacccnggccacgcctccacgccacgcctacactctatagcaacaaaaccnctcgctcttcgtcggggtccctgacctcgtcttctcgtcggcctccnctccttaagggaaaaccaagtcctacgccccctacaccctagtcccggacccgggggacccagggccaggatagactagacttctttaaggttttatttagtttgtacgttaccttattaactggtggggtntcgtgtcttagtttcggtcttcgggacgggaggaccgaagtcgtacgaccgttcacggtcgacgaccgtacggcctccgtaccccgtcgtaccc

SEQ ID NO: 333191 - DNA, 759 bp, Homo sapiens
  misc_feature: GZ8MTXP02GFOWI.15.59.F04.1.454.CMB.2.raw
  modified_base (363)..(363): a, c, t, g, unknown or other
  misc_feature (363)..(363): n is a, c, g, or t
  modified_base (405)..(405): a, c, t, g, unknown or other
  misc_feature (405)..(405): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctgggacgggaccgtcaacactcacttgtggcttgagctcgtggctcggtctctacctccttaccaccccagctggtaccaacacgaccccaggccacgcctccacgcaccgctcattccatacgacaacaaaccncctccgcttccgttctcggggtccctgtactccgtctttccncgttcggcccttacccgtacttcccgttaaacgggaaaaacctaaaacggtcccttccgcccccttcccaaacccgtaaccgttacccgggaaaccccggggggcccccaaggggaccccttaaggaaagttggtaaactaggttaaaaccggttttacgttttaacgtttttaattttaacgtttcggttaccgttacgtttaaatttacggttaacggttacggggttacgttccggttacggttccgttttacgggtttccggggtttcggttacccgggggaacggggtaaacccgggtaacccgtacgggtacccgtttacccggtaaccccggtttacggttaaccgg

SEQ ID NO: 333192 - DNA, 654 bp, Homo sapiens
  misc_feature: GZ8MTXP02FO533.15.59.F04.1.454.CMB.2.raw
  modified_base (320)..(320): a, c, t, g, unknown or other
  misc_feature (320)..(320): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcccttactaccccagctacggtacccaacacgaccccaggcccagccctccacgccacgctcactctaatanacaaccaaaaccacctaccgtccttccgtttcgtacggggtcccctgacctcgtcctttctcgttcggccttccacttcccgtaggaaaaccaaacgtcctacgccccctcaccgacgtaccggaccgggggcccaggacagactgaacttgtaattcttagttttatttagtagttgttacctaagttaataggtggggtctcgttacggtacgttacgtttcgggttcgttaccggggacgggtacgggtaccgaaaggttccgtacgtaacccggttccgtaaggtcccgacggtacccgacggtcccgtccggcccccgtcggttacccg

SEQ ID NO: 333193 - DNA, 556 bp, Homo sapiens
  misc_feature: GZ8MTXP02JRNDP.15.59.F04.1.454.CMB.2.raw
  modified_base (217)..(217): a, c, t, g, unknown or other
  misc_feature (217)..(217): n is a, c, g, or t
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
  modified_base (485)..(485): a, c, t, g, unknown or other
  misc_feature (485)..(485): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttcncagtcgtcccctgggacgggaccgtcacactcacttgtggcttgagctcgtggctcggtctctactcctactccccagctgtaccaacncgaccccaggccacgcctccacgcaccgctcactctatacncaacaaccactcgctctgtcgggtcctgactcgcttcnctcgctccatctagaaacagctcgccctacnccancgaccgggccaggcaagtangatagtatcgttatttatnttcgtacgttctatacgttgtgggtnacgtggtacttcgttcggtcgttacggggaacggaacggtaccgacgtccgtacggtacccgtacgtacgg

SEQ ID NO: 333194 - DNA, 551 bp, Homo sapiens
  misc_feature: GZ8MTXP02IBLT2.15.59.F04.1.454.CMB.2.raw
  modified_base (341)..(341): a, c, t, g, unknown or other
  misc_feature (341)..(341): n is a, c, g, or t
  modified_base (436)..(437): a, c, t, g, unknown or other
  misc_feature (436)..(437): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcagggagtggattctcaggactggtggtgacccaggagccattcgttctcagtcgtccccgtgggacgggacctcacactcacttggtggcttgacgtcttcgtggctcggtctctacctccttacctaccccagcctggtaaccaacacgaccccaggccacgtcccnccacgcaccgctcatctaagtacacaacaaaccaccgtcgtctcttcgtcggggccctggacttcgcttctctacgctcactctagaaacacgcnnccctnacctagccgacggggccaggctagntgatacgatgttatttattntgtntctatgtgngtngtgtcttcgttcgtcgtacggaacggtacgacgcgcgtcgtactcgcg

SEQ ID NO: 333195 - DNA, 592 bp, Homo sapiens
  misc_feature: GZ8MTXP02JDE50.15.59.F04.1.454.CMB.2.raw
  modified_base (317)..(317): a, c, t, g, unknown or other
  misc_feature (317)..(317): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggaccgtcacactcacttgtggcttgagtctcgtggctcgtctctactcctacacccagctgaccacacgacccagccagcctccacgcacgctcatctatacgacaacaaacnctcgtctccttcgtcggggtccctgacctcgtctctctcgcttccntcctaagaaacagctcnccctcaccngtccggaccggggccaggacagctgaatgtaattcttagtttattatttcgtacttaccgttaattagtaggttagggtctcgttggtacctttggtttccggttacggttacggggacgggacggtaaccgagtacgtaccggtacccgttacgtacggccgaacgacccgtaacggccgtcccgtcccccgttcggtaccc

SEQ ID NO: 333196 - DNA, 553 bp, Homo sapiens
  misc_feature: GZ8MTXP02H5NUW.15.59.F04.1.454.CMB.2.raw
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtccccgtgggagggaccgtcacactcacttgtggcttgagctcgtggctcggtctctactccttacctaccccagctacggtaccaacacgaccccaggcccagccctccacgccacgctcatcaatagcaacaaacnctcgctctcgtcggggtcctgactccgcttcncgtgcctcntccttaagaaacaagctcgccctcacctgccgacggggcccaggctagtntgatagtaactttnttatttattgttgttctacttagtataggtggtgtcgtagtcgttcgttcggtcgtcgggacggacggacacgtcgtacgtaccgtgacgtcgacgaccgacgtcccgtcccgtccgtcgtc

SEQ ID NO: 333197 - DNA, 730 bp, Homo sapiens
  misc_feature: GZ8MTXP02GS7BL.15.59.F04.1.454.CMB.2.raw
  modified_base (258)..(258): a, c, t, g, unknown or other
  misc_feature (258)..(258): n is a, c, g, or t
  modified_base (316)..(316): a, c, t, g, unknown or other
  misc_feature (316)..(316): n is a, c, g, or t
tcagtctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtcgtccccgtggacgggaccgtcacactcacttgtggtcttgagctctggctcggtctctactcctacacccngctgaccacacgacccaggccacgcctccacgccacgctcatctatacgcaacaaacnctcgctcttcgtcgggtccctgacctcgcttctcgtcgcctacctactccgttaaggaaaacctacgtccctccgaccccctaccaacccgtacgtaccccgggacccggggggacccccaaggggacccaacggtagtacgaaagttagttaacttcgttttaaggtttttaaatttacgtttcgttacgtttacctttaagttaagttacgggttggggttcgtacggtttcgggtaccgttttacggttttccggggttaaccgggtttccgggggacgggggttaaccgggaaaccgtaacggtcccgttaccggtaccccggttaccggtttaccgggtaacccgaaacccgggtccccggtaaacgggtccccgtacccccggtacccccggtttcggtttacccccg

SEQ ID NO: 333198 - DNA, 741 bp, Homo sapiens
  misc_feature: GZ8MTXP02I7IRN.15.59.F04.1.454.CMB.2.raw
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
  modified_base (388)..(388): a, c, t, g, unknown or other
  misc_feature (388)..(388): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcctactacccagctggtaccaacacgaccccaggccacgccctccacgcacgctcatctanancaacaaacnctcgctcttcgtcgggtcccctgactccgtctttcncgtcgcctccattcccgttaggaaaacaaagcctcgcccctcacccctagtccgaccgggggccccaggactaagntaggaataggaaacttcgtttaagtttttaattagtttcgttcgttaccttaagtaagttaggttggggttcgtccgttgggtaccttacgtttcccggggttacgtttcgggggaccgggtaacggggtaaccctaagggtcccttacgggtaacccggttccgttaaacgggtcccgaacggacccccgtaagggtccccgtcccgtcccccccggttcggttaccctacccgtcccgttttaccccggtccccccggttcccccctttacccggttcccgtacccggtttaaacccggtacgtaacccggttcgggaccgggttcccgggggtaccgtcggggaacccgg

SEQ ID NO: 333199 - DNA, 578 bp, Homo sapiens
  misc_feature: GZ8MTXP02HRF2J.15.59.F04.1.454.CMB.2.raw
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (478)..(478): a, c, t, g, unknown or other
  misc_feature (478)..(478): n is a, c, g, or t
  modified_base (518)..(518): a, c, t, g, unknown or other
  misc_feature (518)..(518): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactggtggtgaccccaggagccatcgttctcagtcgtccccgtgggacgggaccgtcacacctcacttggtggcttgagtctcgtggctcggttctctacctccctacctaccccngctgtaccaacacgaccccgnggccacgcctccacgcacgctcactctatacacaacaaacactcgaccttctcgtccggggtcctcgactcgtcttctctgccttcncttcgtagaaacaanctcnccncnccatccggaccgggccagnagntaganagtacttnttatttattntggttataccgtattagtacggtggtntacgtgttcgtgtttacggtcgtacgggcgaggtaaaccngtccgtacgtcccgtagtacggtcaccgaccgtacgcctcccgtccccgacggttacccc

SEQ ID NO: 333200 - DNA, 580 bp, Homo sapiens
  misc_feature: GZ8MTXP02FHHHU.15.59.F04.1.454.CMB.2.raw
  modified_base (372)..(372): a, c, t, g, unknown or other
  misc_feature (372)..(372): n is a, c, g, or t
  modified_base (481)..(481): a, c, t, g, unknown or other
  misc_feature (481)..(481): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggaccgtcacactcacttgtggcttgagctctggctcggtctctactccttacaccccagctggtaccaacacgaccccaggcccagccctccacgcacgctcatctatagcaacaaaacactcgcttcttcgtcggggtcccctggactccgtcttctcgtggccttcnctccgttaggaaaaccaaagctcgcccctacaccacgtccggaccgggggcccaggcagactgatgaattcttagtttattagtttgtcgtaccttatagtagtgggtntcgtggctagtttcggtcgttcgggacggaggacgaagtcgtacgaccgtccgtacggtccgacgtacccgaacggtcctaccgcccccgtcggtaccc

SEQ ID NO: 333201 - DNA, 534 bp, Homo sapiens
  misc_feature: GZ8MTXP02IOWUS.15.59.F04.1.454.CMB.2.raw
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (379)..(379): a, c, t, g, unknown or other
  misc_feature (379)..(379): n is a, c, g, or t
tcagtctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacctcacactcacttgtggcttgagctctggctcggtctctactccttactaccccagctcggtaccaacacgaccccaggcccagccctccacgcacgctcatcatagacacaaaacnctcgctctcgtgggtccctgactcgcttcnctgctcntcctagaaacagctgccctnaccagtcgacggggccaggctagatgatgaatcttagtttattagtgttgtacctatatagtcggtgcgtagtcctgtttcggacgttcgggcggtacgggaccaggtctcgacctcgtaaggtcacgccgtacgccgtccgccccgttggtccc

SEQ ID NO: 333202 - DNA, 606 bp, Homo sapiens
  misc_feature: GZ8MTXP02JBC5B.15.59.F04.1.454.CMB.2.raw
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (366)..(366): a, c, t, g, unknown or other
  misc_feature (366)..(366): n is a, c, g, or t
  modified_base (417)..(417): a, c, t, g, unknown or other
  misc_feature (417)..(417): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggaccgtcacactcacttgtggcttgagctctggctcggtctctactcctactacccngctgtaccaacacacccngccagccctccacgcacgctcatctatacgacaacaaacacctcgcttcttcgtcggggtccctgactcgtcttctctcggcctccntcctaggaaacaacgcctcgccctcaccactcggaccggggccaggcaganagactagtaattctttagtttatttacgttgttgttaacccttagttaatagttaggggttacgtgttacggtcgttaacgtttccgggtacggttccggggacgggtagggaccctaaaggtcgtaccgtaccgtccgtaggaaccgacgaccccgaaggccccttaccggcccccgttacggtaccc

SEQ ID NO: 333203 - DNA, 883 bp, Homo sapiens
  misc_feature: GZ8MTXP02HV5UI.15.59.F04.1.454.CMB.2.raw
  modified_base (176)..(176): a, c, t, g, unknown or other
  misc_feature (176)..(176): n is a, c, g, or t
  modified_base (309)..(309): a, c, t, g, unknown or other
  misc_feature (309)..(309): n is a, c, g, or t
  modified_base (325)..(325): a, c, t, g, unknown or other
  misc_feature (325)..(325): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccagganccatcgttctcagtcgtcccctgggacgggaccgtcacactcacttggtggcttgagctctggctcggtctctactccttacctacccagtctggaccaacgacgaccccaggccagccctccacgcacgctnatcatagcaacaaacnctcgcttcgtcgtcggggtcctgacgtcgtccttctcgtggtacctacctacgttccgttaaggaaaacctaaaccggtcctaccgaccccttccaaacccgtagacccggaacccgggggccccaaggggtcccaaagtacggtaggtaacttaaggggtaaaacctttttacgttttaaacgtttttaaacgttttacgttttaccggttttaaccgtttaaccgttttaaagttaacggtttaacggggtttccgggggttacggtttaccgggtttaccgggtttaaccggttttaccggggtttttacccgggggttttacccggggtttaacccggggggtaaacccgggggttaaaacccgggggtaaaccccggttaaaccggggttacccggtttaaccccggggttaaacccccggtttaccccgggttaaaccggggtttaacccccgggtaaaaccccggggtaacccccgggggttaaaccccggggttcccccggtttaaccccccccggggtttaccccccggttttacccgggttacccccg

SEQ ID NO: 333204 - DNA, 598 bp, Homo sapiens
  misc_feature: GZ8MTXP02ILZJ4.15.59.F04.1.454.CMB.2.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactcctacacccngctggaccaacngaccccaggccagccctccacgcacgctcatctatagcaacaaacactcgtctcttcgtcgggtccctgactcgcttctctggctccactccttaggaaacaacgctcgccctcacccatcgaccggggccaggcagctgactagtacttcttagtttattattgtctacttatagtagtggtgcgtggtcttagtttcggtcgttcgggacggtacgggaaccaagcttacggacccgttcgtaacggtcaacggaccgtaacgggcctacccggcccccgttcggttacccgaccttccgttcccggttccccctccctacccgttccacgttaaccggacgtacgtcggacgtccgggcgacggaacgg

SEQ ID NO: 333205 - DNA, 544 bp, Homo sapiens
  misc_feature: GZ8MTXP02GL7H0.15.59.F04.1.454.CMB.2.raw
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactacccagctgtaccaacagacccagcagcctccacgcacgctcatctaatagcaacaaaacactcgctcttcgtcggggtcccctgactcgtcttctctggcctcntcctaggaaaacaagctcgcctacactacncgacgggggcccaggcagactgatgaatcttagtttatattgtnttccttatatagtgggngtcgtggtctagtttcgtcgttcgggacgggaacgggaccaaaggtctacgaccgtccgttagcgacgacccaggtcctccgcccctcggtacc

SEQ ID NO: 333206 - DNA, 566 bp, Homo sapiens
  misc_feature: GZ8MTXP02H1V31.15.59.F04.1.454.CMB.2.raw
  modified_base (266)..(266): a, c, t, g, unknown or other
  misc_feature (266)..(266): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
tcagtctacgtagccacgaccggtgctcgattttagtacacacacttagggattgggggaaaaaggccctaaggaaaaacaaaaccccagctgggaagcctgagaacacttagccttcatgagtgtccccaccatggcctggatgatgcttctcctcggactccttgcttatggatcaggagtggattctcagactgtggtgacccaggagccattcgttctcagtcgtcccctgggacgggacctcacactcacttgtggcttgngctcgtggctcggtctctctccttacctacccagctcggtaccaacacgaccccacggccacgccctccacgccacgctacatctatacgacaacaaacncctcgcctctcgtcgggtcctgctcgtctctctgctcnctctagaacancncgccctacncanccgaccggggccacgcgagactgactgattccttagtttattacttntgttcttaatcttagtggngtcgtcggcttacgttttcggtcgttcggacggggaacggtacgacggtcgtcgaccgttcgtacggtccg

SEQ ID NO: 333207 - DNA, 556 bp, Homo sapiens
  misc_feature: GZ8MTXP02JEXWN.15.59.F04.1.454.CMB.2.raw
  modified_base (217)..(217): a, c, t, g, unknown or other
  misc_feature (217)..(217): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccngctggtaccaacacgaccccaggccagccctccacgcacgctcatctatagcaacaaacactcgctcttctcgggtccctgactcgcttctctggctcactccgttaggaaacaaagctgccctcacccactcgaccggggcccaggcagntgatagatctagtttatattgttntcctatatgtgggtncgtgtcttagttcgtcgtcggcggacgggactagctacgaccgtcgtacgtacacgaccgaggcctccgtccccgtcgtcctaccttccgtccgttcccgtccctccgtacgtccgtaacgtacgacgtcggacggtccggcgtcggcg

SEQ ID NO: 333208 - DNA, 628 bp, Homo sapiens
  misc_feature: GZ8MTXP02H2WGV.15.59.F04.1.454.CMB.2.raw
  modified_base (391)..(391): a, c, t, g, unknown or other
  misc_feature (391)..(391): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtcccccaccatggcctggatgatgcttctcctcggactccttgcttatggatcaggagtggattctcagactgtggtgacccaggagccatcgttctcagtgtcccctggagggaccgtcacactcacttgtggcttgagctcgtggctcggtctctactccttacctaccccagctcggtaccaacacgaccccagccacgccctaccacgcacgctcatctaatagacaacaaccactcgctcttcgtcgggtcctgactctccttcnctcgctccatccttaggaaacaagcctcgccctacaccgacgtcccggaccgggggacccacgggacagaacgttgaatacgtaactcgtttagtttaactttagttcgttacgttaccttaagttagttacggtgggttcgtacgttcgggacgtttacgtttccgggttacgttccgggggaacggtaacggggaaccctacgggaccttaccgggtaccgttacccgtacgggg

SEQ ID NO: 333209 - DNA, 574 bp, Homo sapiens
  misc_feature: GZ8MTXP02HXLDY.15.59.F04.1.454.CMB.2.raw
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
  modified_base (400)..(400): a, c, t, g, unknown or other
  misc_feature (400)..(400): n is a, c, g, or t
tcagtctacgtagccacgaccggtgctcgatttagtacacacacttagggattgggggcctggatgatgcttctcctcggactccttgcttatggatcaggagtggattctcagactgtggtgacccaggagccatcgttctcagtcgtcccctgggagggaccgtcacactcacttgtggcttgagctctggctcggtctctactcctactacccagctggtaccaacacgaccccaggccagcctcacgcacgctcatctatagcacaaacactcgctctctggggtccctgatcgctctctgctccntcccttggaaaacaaagctgcccctacacccctatcgaacgggggcccaaggccaaggntggaatgaaatcgttatttatttaactgttntctatatagtgtgtgtgtcgtacgtttcgttcgttcggtacgggacggaacgaagacgtacgtacgtaccgtacgtacgacgaccgacgacgtccgccccgtccgtctacctccgtccgttcccgtcccgtccgtccgtacgtaacgtacgtacgacgacggcggcgtacgacg

SEQ ID NO: 333210 - DNA, 694 bp, Homo sapiens
  misc_feature: GZ8MTXP02F51HR.15.59.F04.1.454.CMB.2.raw
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
tcagtctacgtagccacgaccggtgctcgatttagtacacacacttagggattggggggggaagcctgagaacacttagccttcatgagtgtccccaccatggcctggatgatgcttctcctcggactccttgcttatggatcaggagtggattctcagactgtggtgacccaggagccatcgttctcagtcgtccctggagggaccgtcacactcacttgnggcttgagctctggctcggtctctactccttactaccccngctggtaaccaacacgaccccaggccagccctaccacgcacgctacactctatacgacaacaaaacactcgcttcttcgtcggggtcctgactccgtcttcgtctgcctaccctatccgttaggaaaactaaaacgcgtacgtacccctcaaacccgtagtacccggacccgggggcccaagggtcccgaaagtacgtaggatacgtaaaacgttctttagttttaatttaagtttcggtttacgttaccgttaaattaagttaacggttggggtacggtaccgttaggggtccttaacggtttttcgggtaacggtttcggggacggggtaacgggacctaaagggccgttacggtaccccggttacgttacggggtaaccgtaaccgaccgaaacgggttccgtcccggtcccccgttacgggtttcccc

SEQ ID NO: 333211 - DNA, 546 bp, Homo sapiens
  misc_feature: GZ8MTXP02GG217.15.59.F04.1.454.CMB.2.raw
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
tcagtctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttacaccccagctggtaccaacagaccccaggccagccctccacgcacgctcatctatagcaacaaaccnctcgctcttcgtcggggtccctggactccgcttctctggcctcncgttccgttaggaaaacctaacgctacgccctcacatccgacgggggcccaggcagctagatgaattcttagtttattnttgtctactatagtagcgggtngtacggtctagtttcgcgttcggcggaggacaagctacgccgttcaaggtcacgccgaagccgtaccgccccgtacgtccc

SEQ ID NO: 333212 - DNA, 705 bp, Homo sapiens
  misc_feature: GZ8MTXP02FNJ0N.15.59.F04.1.454.CMB.2.raw
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
tcagtctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagtactggtggtcacccgagggacnccatccgttcncagtccgtccccgngggacgggcctcactactctacgttgtggactttggactctcgtcggtcgtccggtcctactaccttcccttacctacccccgagtcctacggtaaccccaaaccgacgaccccgacggcccacgccctccacgtcaccgctcatacctatacgaccaacaaaccacctcgactcttcgtcggggtccctgacttcgtctttacctcgtggtccctccgtacttaccgttacggaaaacaacgctcgtaccctaccaccgaccgtcggacccggggacccgaggtccgaaggactggaatcggtaaattcttagttttattacgtttgtcttacgtttataggtttacggtcggtagtccggttagtaccgtttacggtttcccggtttcgggttaacggggtaaccggttaacgggaacccgttaaaacggtcccgtttaccggacccgttaccgttaacccggggg

SEQ ID NO: 333213 - DNA, 595 bp, Homo sapiens
  misc_feature: GZ8MTXP02FZJ0D.15.59.F04.1.454.CMB.2.raw
  modified_base (361)..(361): a, c, t, g, unknown or other
  misc_feature (361)..(361): n is a, c, g, or t
  modified_base (483)..(483): a, c, t, g, unknown or other
  misc_feature (483)..(483): n is a, c, g, or t
tcagtctacgtagccacgaccggtgctcgatttagtacacacacttagggattggggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaaacactcgctcttctggggtccctgacctcgcttctctggcctcntaccttagggaaaacaaagctagcccctacaaccctatacccgtaaccgggggcccaggcaacgatagactagaatctagtttattattgtgttacctattataagtggggtgtcgtacggntagtttcgttacgttcgggcggtagggggaacccaaaggcgtacgtaacccgtccggtaaaggtccgaacggtaccccaaaacgggtcgtaccgccccccgttaggtacccc

SEQ ID NO: 333214 - DNA, 524 bp, Homo sapiens
  misc_feature: GZ8MTXP01CRDHI.4.23.C01.1.454.CMB.2.raw
  modified_base (367)..(367): a, c, t, g, unknown or other
  misc_feature (367)..(367): n is a, c, g, or t
tcagagcactgtagcacgaccggtgctcgatttagtacacgtgattagggattggggacccaaaaccacacccctccttgggcgaatcccctagatcacagctcctcaccatggactggacctggagcatccttttctggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatcgcacagacgttccaagggcngagtcaccataccacagacacatccacgagcacagccctacatggacctgaggagccgtgagatttgacgacacggccatatattactgtgcgagagagttgggaccgacggaaccgttgacgtaagtggggcgagggacccgttggtccgcgtccg

SEQ ID NO: 333215 - DNA, 539 bp, Homo sapiens
  misc_feature: GZ8MTXP01BV0AP.4.23.C01.1.454.CMB.2.raw
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttacacctatggtgtcaactgggtgcgacaggcccctggacaagggcttgagtggatgggatggatcagcgcttacaagtgggaacacaaactatcgcanagacgttcaagggcngagtcacataccacagacacatccacgagcacacgcctacatgacctgaggagccgtgagtatttagacgacacggaccagtactattactgtgcgagagtagttgggccgaacggttaaaccgttgacctaacgtggggccgagggacccgttgggtccgaaccggttcc

SEQ ID NO: 333216 - DNA, 535 bp, Homo sapiens
  misc_feature: GZ8MTXP01C94PZ.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaactgggtgcgacaggcccctggacaagggcttgagtggatgggatggatcagcgctttacaatgggaaacacgaaactatacgcacagacgttccaaagggcaagagtcacattaccacagacacataccacgagcacagcctacatggacctgaggagccgtgagatttgacgacacggccatatattactgtgcgagagattggggacgacggaaaccgttgactaacgtggggccacgggaaccgttcggtcaaccggtccg

SEQ ID NO: 333217 - DNA, 611 bp, Homo sapiens
  misc_feature: GZ8MTXP01DYWAX.4.23.C01.1.454.CMB.2.raw
  modified_base (266)..(266): a, c, t, g, unknown or other
  misc_feature (266)..(266): n is a, c, g, or t
  modified_base (605)..(605): a, c, t, g, unknown or other
  misc_feature (605)..(605): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtcgcccactcccaggttcacctggagcagtctggacctgaggtgaagagccgtgggctcagtgagtctctgcaaggcttctggctactacctttaccacctagtggtntcaacgtgggtgcgacgacggcccctaggaacgaagggtcttggaggtggagtgggatggatcgagcgtactttaacgaagtagggaaacaacgtaaaactagtaccgacaacgaaggtaccggttaccgaaagggggaccaagggactaccaaaccctaacttaacccaacagaaccacaactaccaacgacacaacgacgacctaacagtacggacctaggaggacgccgtaggagtattacgacgacacggacaatatattactgtgaacgagagtagttcgggaccgtaacgaacgttgactaacggtcgggccgacgggaccttcgggtaaccnccgtcc

SEQ ID NO: 333218 - DNA, 541 bp, Homo sapiens
  misc_feature: GZ8MTXP01DYF8U.4.23.C01.1.454.CMB.2.raw
  modified_base (372)..(372): a, c, t, g, unknown or other
  misc_feature (372)..(372): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgctttaacaatgggaacacaaactatcgcacagacgttccgaagggcngagtcaacataccacagacacatccacgagcaacagacctacatggacctggaggagccgtgagtattgacgacacggccatatattactgtgcgagagtagttgggaccgaacggaaaccgttgactaacggtgggccgacggggacccttgggtccgaaccggttcc

SEQ ID NO: 333219 - DNA, 675 bp, Homo sapiens
  misc_feature: GZ8MTXP01EFSSM.4.23.C01.1.454.CMB.2.raw
  modified_base (404)..(404): a, c, t, g, unknown or other
  misc_feature (404)..(404): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtggtgcgacaggcccctggacaagggcttgagtggatgggatggatcgagcgctttaacaagtagggaaacaacaaactatacggacaacgagaccgttccgaaagggcaaggacgtcaaccattacccanacgacacaactaccaacgacgacaactacgaccctaacaacgtacgggaacccgtaggaacgggacgacccggtaggtacgtaacgtttacggaaccgaacgaccggtacccaaagttaattaacgttaaccgtggttaggccggtaaaggttaggtaacggttcggggacccggtaacgggttaaacccgttggaaaccgttaacgggtacgggggaacccgtaacgggggtaccccgttacgggtaacccgttaacccgggtttccccg

SEQ ID NO: 333220 - DNA, 531 bp, Homo sapiens
  misc_feature: GZ8MTXP01ELNN2.4.23.C01.1.454.CMB.2.raw
  modified_base (370)..(370): a, c, t, g, unknown or other
  misc_feature (370)..(370): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgctttacaatgggaacacaaactatcgcacagacgttccaagggcngagtcaccattaccacagacacatccacgagcacagcctacatggacctgaggagccgtgagtatttgacgacacggccatactattactgtgcgtagagagttgggaccgacggaaccgttgactaacgtggggccaggggacccttggtccgaacgtcc

SEQ ID NO: 333221 - DNA, 542 bp, Homo sapiens
  misc_feature: GZ8MTXP01B35ON.4.23.C01.1.454.CMB.2.raw
  modified_base (279)..(279): a, c, t, g, unknown or other
  misc_feature (279)..(279): n is a, c, g, or t
  modified_base (402)..(402): a, c, t, g, unknown or other
  misc_feature (402)..(402): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtncgacaggcccctggacaagggcttgagtggagtgggatggatcgagcgctttaacaagtgggaaacacgaaactatcgacacagaccgttccaagggcaagagtcaccataccacagacacanccacgagacacagcctacatcggacctgaggtacgccgtgagtattcgaacgacacggccaatatattactgtgcgagagagttgggaccgtacggaacgttgactaacgtgggccagggacccttggtccgaaccgtcc

SEQ ID NO: 333222 - DNA, 689 bp, Homo sapiens
  misc_feature: GZ8MTXP01BJ27O.4.23.C01.1.454.CMB.2.raw
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaactgggtgcgacaggcccctggacgaggctgagtggagtggatggatcgagcgtacttaanaagtagggaaaccaacaaactatcgacacgagtaccgttaccgaagggacaaggacgtaccaacctaactaccaacgacgaaccacactaccgacgacgaccacgaacgaccctaacacgtacggacctagggacggacggccgtaggtaacgtacgtttacggaaccgaaccgaccgggacctaaacgttattaactttaccgtggttacgaacggtaacggaaggttacgggttacggggaccccgggtaaacgggttaaaacccgttggttaacccggttaacgggttcccgggggaaccgaaacccgggggttaaccccgttcggggtaacccgttaaccccgggtttccccg

SEQ ID NO: 333223 - DNA, 580 bp, Homo sapiens
  misc_feature: GZ8MTXP01AIAEE.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgctttaacaagtgggaaacacaaactatcgacacagtacgttccgaaggggcaaggacgtcaccattaccacacgacacactaccaacgacgacaacacgacctacacgtaggaccctggaaggacgccgtaggagtagttacgacgacgacggacctagtatattactgtgaacgagagtagttcgggaccgaacggttaaccgttgacgtaacggtcggggccacggggacccgttcgggtccgaaccggtccc

SEQ ID NO: 333224 - DNA, 737 bp, Homo sapiens
  misc_feature: GZ8MTXP01CTVFC.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagagccgtgggcctgagtgaggtctctgcaaggcttctggctactacctttaccacctagtggtgtcaacgtgggtgcgacgacggcccctggacaagggcttggaggtggagtgggatggatcgagcgtactttaacgaagtagggaaacaacaaactagtacgacaacgacggtaaccgttaccgaaaggggacaaggtaacgtaccaaaccctaacttaacccaacacgaacctttaacaactaccgaacgacgaccaacaacgacctaacgaacgtacggaccgtaggaacggacgccggtaggtaagttaacgtttacggaaccgtaacgaaccggtacctaaacgttaattaagttaccgtggttacggaacggaaggttaacgggttacggttaccgggggaacccgggtaaaccgggttaaaacccggtttacggttaacccggttaaccgggttaccgggggaacccggtaaccgggggtaaaccccggttaccgggttaaccccgttaacccgggtttccccg

SEQ ID NO: 333225 - DNA, 696 bp, Homo sapiens
  misc_feature: GZ8MTXP01C7J1E.4.23.C01.1.454.CMB.2.raw
  modified_base (217)..(217): a, c, t, g, unknown or other
  misc_feature (217)..(217): n is a, c, g, or t
  modified_base (269)..(269): a, c, t, g, unknown or other
  misc_feature (269)..(269): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctgggcctnagtgaaggtctcctgcaaggtcttcgtggctacacctttaccacctatggtntccaacgtgggtgcgacgacggcccctggacgaagggcttgagtggagtgggatggatcgagcgactttaacgaagtgggaaacaaacgtaaaactagtaccgacaacgacggtaacgttacccgaaaggggaccaaggtaacgttacccaaacctaacgttaaaccccaacgaaacgaaacccaacctaactaccccgaaccgggaacgaccaaccgaaccgtacccttaacgaacgttacggaacccgtaggaacgggacgcccgtaggtaacgtagtttacggaacgacgaccggacctaagtactagtactgtgaacgaagagtacggttcgggaaccgtaacggttaaacccgttggaaccgttaacgggtcggggaaccgaacgggtaacccgttcggtaacccgttaacccgttaacccg

SEQ ID NO: 333226 - DNA, 540 bp, Homo sapiens
  misc_feature: GZ8MTXP01BYPXJ.4.23.C01.1.454.CMB.2.raw
  modified_base (473)..(473): a, c, t, g, unknown or other
  misc_feature (473)..(473): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaactgggtgcgacaggcccctggacaagggcttgagtggatgggatggatcagcgctttacaagtgggaacacaaactatcgacacagacgttccaagggcaagagtcaccataccacagacacataccacgagacacacgcctacactggacctgagacgccgtagagtatttgacgacacggaccatatatactgtgcgagngagttgggaccgacggaaccgttgacgtaacgtggggccacggggacccttggtccgaacgttcccg

SEQ ID NO: 333227 - DNA, 612 bp, Homo sapiens
  misc_feature: GZ8MTXP01DT8QC.4.23.C01.1.454.CMB.2.raw
  modified_base (216)..(216): a, c, t, g, unknown or other
  misc_feature (216)..(216): n is a, c, g, or t
  modified_base (266)..(266): a, c, t, g, unknown or other
  misc_feature (266)..(266): n is a, c, g, or t
  modified_base (511)..(511): a, c, t, g, unknown or other
  misc_feature (511)..(511): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctnagtgaaggtctcctgcaaggcttctggctacacctttaccacctatggtntcaactggtgcgacaggcccctggacaagggcttgagtggatgggatggatcgagcgtctttaacgaagtagggaaacaacgaaactagtacgacaacaggtaccgttacccgaaaggggccaaggacgtaccaaccaacttaacccaacacgacacaactaccgaacgacgaccaacacgacctacagtacggacctagaggacgccgtagaagtattagacgacacggaccaatatattacgngtgaacgagagtagttcggggaccgtaacggaaaccgttgaccgttaacggcggggaaccgaacgggtaacccgttcgggtaaccgttaacccggttcccg

SEQ ID NO: 333228 - DNA, 549 bp, Homo sapiens
  misc_feature: GZ8MTXP01DM4CH.4.23.C01.1.454.CMB.2.raw
  modified_base (218)..(218): a, c, t, g, unknown or other
  misc_feature (218)..(218): n is a, c, g, or t
  modified_base (422)..(422): a, c, t, g, unknown or other
  misc_feature (422)..(422): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctnagtgaaggtctcctgcaaggcttctggctacacctttaccacctatggtgtcaactgggtgcgacaggcccctggacaagggcttgagtggatgggatggatcagcgcttaacaatagggaaacaacaaactatacgacacagacgttaccgaagggcaaggagtcaaccattaccacagacacatccacgagacacagcctanatacgacctggaggacgcgtagagactttagacgacgacggccaatatattactgtgcgagagtagttgggaccgaggaaacccgttgactaacgtggggaacacgggacccttggtccgaacgtcc

SEQ ID NO: 333229 - DNA, 602 bp, Homo sapiens
  misc_feature: GZ8MTXP01C5IW3.4.23.C01.1.454.CMB.2.raw
  modified_base (278)..(278): a, c, t, g, unknown or other
  misc_feature (278)..(278): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttacacctatggtgtcaactgggtncgacaggccccctggacgaagggcttgagtggagtgggatggatcaggcgacttaacaagtagggaacaacaaactatcgacaacaggtaacccgttaccgaaggggaccaaggacgtaccaaaccctacttaacccacgaagaccacactaccacgacacaacaacgcctaacagtacgacctagaaggcgacctggaagtagttagacgacacggcctaatatatagtgtgaagagagtagttcgggaccgaacggttaaacccgtttgaacgttaacggtagggggccgaacgggaacccgttgggtccaaccggtttccc

SEQ ID NO: 333230 - DNA, 528 bp, Homo sapiens
  misc_feature: GZ8MTXP01DWGOG.4.23.C01.1.454.CMB.2.raw
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
tcagagcactgtagcacgaccggtgctcgatttagtacacgtgattagggattggggacccaaaaccacaccctccttgggcgaatcccctagatcacagctcctcaccatggactggacctggagcatcctttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatcgcacagacgtccaagggcngagtcaaccataccanagacacatccacgagcacagcctacatgacctgagagccgtgagattgacgacacggccaatatattactgtgcgagagagttgggaccgtacggaaaccgttgacgtaacgtggggccgtagggacccgttggtccgaacggtccg

SEQ ID NO: 333231 - DNA, 599 bp, Homo sapiens
  misc_feature: GZ8MTXP01ECKPA.4.23.C01.1.454.CMB.2.raw
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (413)..(413): a, c, t, g, unknown or other
  misc_feature (413)..(413): n is a, c, g, or t
  modified_base (567)..(567): a, c, t, g, unknown or other
  misc_feature (567)..(567): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagccgtggggcctcagtgaaggtctcctgcaaggcttnggctactaccttaccacctatggtntcaacgtggtgcgacacggccctggacgaagggcttgagtggagtgggatggatcgagcgtactttaacaagtgggaaacaacgaaactatcgacacacggacgttaccgaaagggacaaggagtaccaacctattaacccaanacgaacacactaccaacgagacaacacgaccctaacacgtacgggacctagaacgggacgccggtaggaagttagtttacggaacgaaccgacggaccaattattatactgtgaacgagagagttgggaccgaacggaacgttgacgtaacggngggaaccgacgggaccgttggtccaaccgtcc

SEQ ID NO: 333232 - DNA, 659 bp, Homo sapiens
  misc_feature: GZ8MTXP01D21N1.4.23.C01.1.454.CMB.2.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (313)..(313): a, c, t, g, unknown or other
  misc_feature (313)..(313): n is a, c, g, or t
tcagagcactgtagcacgaccggtgctcgatttagtacacgtgattagggattggggacccaaaaacccacacccctccttgggcgaatcccctagatcacagctcctcaccatggactggacctggagcatccttttcttggtggcagcagcaacaggtgcccactcccaggttcacctggagcagtctggacctgaggtgaagagccgtgggcctcagtgagtcnctgcagctngctacncttacnctangtncatggngcncagccctgacgaggctgagtggagtggagtggatcgagcgtactttaanaagtaggaaaccaacaaactacgtcgaccaacgacgtacccgttaccgaacggggtactaagttaacgtacccaaaccctaacttaacccaacaacgaaccaccaactacccgaacgacgaccaaccgaacgtaccctaacgacgtaccggaacctaggaacggaccgtaccggtaaggtaacgtaacgtttacgaaccgaccgaacggacctaagttacttaattaccgtgtcgtaagtaagttaggtacggtttcggaaccggtaaccggttaaaccgttcggttaaccgtaacgggtacgggaaccgtaacgggtacccgttacggttcccgaaccgttcccg

SEQ ID NO: 333233 - DNA, 580 bp, Homo sapiens
  misc_feature: GZ8MTXP01CFW3W.4.23.C01.1.454.CMB.2.raw
  modified_base (240)..(240): a, c, t, g, unknown or other
  misc_feature (240)..(240): n is a, c, g, or t
  modified_base (494)..(494): a, c, t, g, unknown or other
  misc_feature (494)..(494): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaggtctcctgcaaggcttntggctacacctttacacctatggtgtcaactgggtgcgacaggcccctggacaagggcttgagtggatgggatgggatcgagcgctttaacgaagtagggaaacaacaaactatcgacacagacgttccgaagggcaagagtacacataccacagacacactaccacgacgacacacgacctaacacgtacggacctagaggacgccggtagaacgtatttacgacgacgacggacctatataattactgtcgnggtagagtagttcgggaccgaacggaaaccgttgaacgttaacggtacggggccgaacgggtaccgttacggtccgaaccgtcccg

SEQ ID NO: 333234 - DNA, 552 bp, Homo sapiens
  misc_feature: GZ8MTXP01BRYEV.4.23.C01.1.454.CMB.2.raw
  modified_base (373)..(373): a, c, t, g, unknown or other
  misc_feature (373)..(373): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgctttacaagtgggaacacgaaactatcgacacagacgttccaagggcngagtcaccataccacagacacatccacgagacacagcctacatgacctgaggacgccgtgagtattgacgacgacggcatatattactgtgcgagagagttcgggaccgtaacggaacccgttgaccgtaacgtcggggaacccgacggggaccccttgggtcccgaacccggttcccg

SEQ ID NO: 333235 - DNA, 638 bp, Homo sapiens
  misc_feature: GZ8MTXP01ALNKZ.4.23.C01.1.454.CMB.2.raw
  modified_base (387)..(387): a, c, t, g, unknown or other
  misc_feature (387)..(387): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtgggtgcgacacggcccctggacaagggcttgagtggatgggatggatcgagcgcttacaagtgggaaacacaaactatcgacacagacgtcaagggcaagagtcacataccanagacacatccacgacgacacacgacctaacagtacggacctggacggacgccgtgaagtagtttacggaaccgaacgaccgggacctaattaactaactttacgtggtacggtaacggtaaggaaggtacggtttaccgggggaacccggtaaaccggggttaaacccgttcgggttaccgttaaccgggtacgggggaacccggaacgggggtaaccccgttggggttaacccgttaacccgggttcccg

SEQ ID NO: 333236 - DNA, 704 bp, Homo sapiens
  misc_feature: GZ8MTXP01C48P0.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtgggtgcgacaggcccctggacaagggcttgagtggatgggatggatcgagcgactttaacaagtgggaaacaacgaaactatcgacaacgagaccgttcccgaaaggggcaaggacgtaccaaccctaacttacccaacagaaccacactaccaacgacgacaacacgaccctacagtacggaccgtaggaacgggacgaccgtaggaagtaacgtttacggaaccgaaccgaaccgggaccctaaagttaacttaacgtttaaccgtggttacggaacggtaaggttaaagggtaacggtttcgggggaaccccggtaaccggggttaaaaacccgtttcgggaaacccgttaaccgggtaccgggggtaacccggtaaccgggggtaaaccccgttcggggttaaccccgttaacccgggtttccccg

SEQ ID NO: 333237 - DNA, 670 bp, Homo sapiens
  misc_feature: GZ8MTXP01DL0OT.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaactgggtgcgacaggcccctggacaagggcttgagtggatgggatggatcgagcgctttacaagtgggaaacacaaactatcgacacgagacgttccgaagggcaagacgtcaaccataccacagacacataccacgagacaacacgcctaacagtcggacctggaacgggacgaccggttaggaacgttaagttttacggaaccggaaccgaaccgggacctaaagttaagttaactttaaccgttgggttacggaacggaaggttaacggttaggtttacgggggacccggtaaccgggttaaaacccgtttcggaaacccgtttaacgggtaccggggggaacccgtaaccgggggtaaaccccgttcggggttcccgttaaccccgggtttccccg

SEQ ID NO: 333238 - DNA, 597 bp, Homo sapiens
  misc_feature: GZ8MTXP01B0J1S.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaagtgggaacacaaactatcgcacagacgttacgaagggcaatacgtcaccacttaccacagaacacatcccaacgacgacacacgcctaacatcggacctggaacgggagcccgtaggaacgtatttacggaaccggacacgggacctaagtaataattactggtgaacggagagtagttcgggaccgaacgggttaaaccgttggaccgtaacggtacgggggaacccgacgggggtaacccttcgggtcccgaaccggttcccg

SEQ ID NO: 333239 - DNA, 581 bp, Homo sapiens
  misc_feature: GZ8MTXP01EOWKD.4.23.C01.1.454.CMB.2.raw
  modified_base (503)..(503): a, c, t, g, unknown or other
  misc_feature (503)..(503): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtgggtgcgacgacggcccctggacaagggcttggagtggatgggatggatcgagcgctttaacgaagtgggaaacacaaactatcgacacagacgttccgaagggcaaggagtacacctacttaaccacacgacacataccaacgacgcaacacgcctacatcggacctgacggacgccgtagagtatttacggaacgacgacggacctatactattactgtgcgagagngttacggaccgaacggttaaccgttcgacgtaacgtcggggaaccgaacgggacccgttaggtcccgttaaccgtccg

SEQ ID NO: 333240 - DNA, 544 bp, Homo sapiens
  misc_feature: GZ8MTXP01B1CRY.4.23.C01.1.454.CMB.2.raw
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (409)..(409): a, c, t, g, unknown or other
  misc_feature (409)..(409): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgcttacaagtgggaacacaaactatcgcanagacgtccaagggcngagtcacataccacagacacatccacgagcacagcctanatgacctgaggagccgtgagtattgacgacacggccatatattactgtgcgagagagttggggaccgaacggttaaaccttggacgtaacggtcggggaaccgacggggaacccttcgggtccttaaccggtccc

SEQ ID NO: 333241 - DNA, 568 bp, Homo sapiens
  misc_feature: GZ8MTXP01DC2LX.4.23.C01.1.454.CMB.2.raw
  modified_base (370)..(370): a, c, t, g, unknown or other
  misc_feature (370)..(370): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtggtgcgacaggcccctggacaagggcttgagtggatgggatggatcagcgcttacaagtgggaacacaaactatcgcacagaccgttccaagggcngagtccaccattaccacagacacactaccacgacgcaacacgacctacatacggacctggaaggcgccgtagtagtatttcgaaccgacgaccggccatatattactgtgcgagagtacgttgggacccgtaacggaaccgtttgacgttaacggtcggggtccgacggggaacccgttcggtaaccgccggttcccg

SEQ ID NO: 333242 - DNA, 603 bp, Homo sapiens
  misc_feature: GZ8MTXP01CO45F.4.23.C01.1.454.CMB.2.raw
  modified_base (279)..(279): a, c, t, g, unknown or other
  misc_feature (279)..(279): n is a, c, g, or t
  modified_base (444)..(444): a, c, t, g, unknown or other
  misc_feature (444)..(444): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagctggggcctcagtgaaggtctcctgcaaggcttctggctacacctttaccacctatggtgtcaacgtgggtncgacacggcccctggacaagggcttgagtggatgggatggatcgagcgcttacaagtgggaaacacgaaactatcgacacagacgttccaagggcaagagtcaacctactaaccacagacacactaccaacgagaccaacacgaccctaacaactcgggaacccnggaacgggagccgtagaaggtactttcggaaccgacaccggccaaatatattaccgtgtgaacgaagagtagttcggggaccgaacggttaaaccgttggaaccgtaacggtcgggggaaccgaacggggtaacccttgggtcccgttaaccgttcccg

SEQ ID NO: 333243 - DNA, 559 bp, Homo sapiens
  misc_feature: GZ8MTXP01AJ16Q.4.23.C01.1.454.CMB.2.raw
  modified_base (552)..(552): a, c, t, g, unknown or other
  misc_feature (552)..(552): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatgggatcgagcgctttaacgaagtggggaacaacaaactatcgacacagacgttccaagggcaagagtccacataccacagacacatccacgagacacagcctacagtacggacctggaggacgccggtgaggtatttcggaacggacgacggaccaatatattactgtggcgagagagttgggaccgacggaaaccgttgacgtaacggtcggggccgacgggacccgttggtccnccggtcc

SEQ ID NO: 333244 - DNA, 732 bp, Homo sapiens
  misc_feature: GZ8MTXP01D0236.4.23.C01.1.454.CMB.2.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtgggcctcaggtgaaggtctcctgcaaggtcttntggctactaccttaccacctatggtntacaacgtgggtgcgacgacggcccctaggacgaagggtcttggagtggagtggatggatcgagcgtacttaacgaagtagggaaacaacaaactagtacgacaacgagtaccgttccgaaagggcaagggacgtaccaaaccctaacttaacccaacgaacgaaccaacactacccgaacgacgacacgaacgacccttaacacgtacggacctaggaacggtacgccggtaggaagttaagtttacggaaaccgaccgaccggacctaaagttacttaacgtttaacgtcggtggaacggtaaggagggttaacgggtttaccgggggaaaccccgggtaaacccggggttaaaacccgtttcggaaaccggtttaacccggggttacgggggaaccccggtaaaccgggggtaaacccccgtttcggggtaaccccgttaaccccgggtttaacccccg

SEQ ID NO: 333245 - DNA, 618 bp, Homo sapiens
  misc_feature: GZ8MTXP01ER7HZ.4.23.C01.1.454.CMB.2.raw
  modified_base (241)..(241): a, c, t, g, unknown or other
  misc_feature (241)..(241): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttntggctactacctttaccaccttatggtgtcaacgtgggtgcgacgacggcccctggacgaagggcttggaggtggagtgggatggatcaggcgtacttaacaagtagggaaacaacaaactatacgcaacgagtaccgttaccgaagggcaaggacgtaccaacccaagtttacccaacgacgaacaaccactacccgaacgacgacacgaacgacctacacgtcggacctgaggacgccgtagagtattacgacgacgacggcctaatatatacgtgtgcgagagtgttcgggaccgtaacggttaaaccgttcgaaacgttaacggcggggaaccgacggggaacccttgggtaacccgttcccggttaaccccg

SEQ ID NO: 333246 - DNA, 538 bp, Homo sapiens
  misc_feature: GZ8MTXP01BA3DN.4.23.C01.1.454.CMB.2.raw
  modified_base (473)..(473): a, c, t, g, unknown or other
  misc_feature (473)..(473): n is a, c, g, or t
tcagagcactgtagcacgaccggtgctcgatttagtacacgtgattagggattggggacccaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgcttacaagtgggaacacaaactatcgacacagacgtccaagggcaagagtcaccataccacagacacataccacgagcacacgcctacatcgacctgagacgccgtagacgtattagacgacacggaccagtatattactgtgcgagngattgggaccgacggaaccgttgacgtaacgtggggccacggggacccttgggtccaaccggtcc

SEQ ID NO: 333247 - DNA, 541 bp, Homo sapiens
  misc_feature: GZ8MTXP01EC05L.4.23.C01.1.454.CMB.2.raw
  modified_base (356)..(356): a, c, t, g, unknown or other
  misc_feature (356)..(356): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatgggatcgagcgcttacaatgggaacacaaactatcgacanagacgttccgaagggcaagagtcacattaccacagacacataccacgagacacacgcctacatgacctgagagccgtagagatttagacgacacggcaatatattactgtgcgagagagttgggaccgacggttaaacttgacgtaacgtcggggcgacgggaaccgttcggtccgaacgtcccg

SEQ ID NO: 333248 - DNA, 684 bp, Homo sapiens
  misc_feature: GZ8MTXP01B4OR2.4.23.C01.1.454.CMB.2.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (582)..(582): a, c, t, g, unknown or other
  misc_feature (582)..(582): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactccccaggttcacctggagcagtctggacctgaggtgaagagccgtgggcctnagtgaaggtctcctgcaaggcttnggctacacctttaccacctatggtgtcaacgtgggtgccgacgacggccccgtaggacgaagggtcttaggaggtggagtgggagtggatcgaggccgtactttaacgaagtacgggaaacaacgtaaactagtaccgaccaacgaacggtaacccgttaccggaaagggacaacgggtacgtaccgaaaccctaaacgttaaccccgaacgaaacgaaccaacaactacccgaacgacgacaacgaacgacctaacgagtacggacctaggaacggtacgcgtaggaacgttattacggaaccgtacgaccggactaaagtattaacgtagttacggngtaacgaaggagtacgttcgggaacccgtaacggttaacgttcgacgttaacgggacggggaaccgtaacgggacccgttaggtcccgttaaccggttcccg

SEQ ID NO: 333249 - DNA, 714 bp, Homo sapiens
  misc_feature: GZ8MTXP01BAEQB.4.23.C01.1.454.CMB.2.raw
  modified_base (268)..(268): a, c, t, g, unknown or other
  misc_feature (268)..(268): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaacgtgggtgcgacacggcccctggacaagggcttgagtggatgggatgggatcgagcgactttaacgaagtgggaaacacaaactatacgacacgagaccgttaccgaagggccaagtacgtaccaaccctaattaacccaacacgaaccacaactacccgaacgacgaccaacaacgaccctaacgacgtacggaccgtaggaacggacgccggtaggaacgtaagtttcggaaaccgaaccgaccgggtacctaaattaattaacgttaacgtggtacggaaccggtaaggttaagggtaacggtttaccgggggaaacccggtaaaccggggttaaaaccccgtttcgggttaaacccggttaaccggggttacgggggaaccccggtaaccgggggtaaccccgttaccggggtaaccccgttaacccgggtttccccg

SEQ ID NO: 333250 - DNA, 598 bp, Homo sapiens
  misc_feature: GZ8MTXP01C3JB5.4.23.C01.1.454.CMB.2.raw
  modified_base (433)..(433): a, c, t, g, unknown or other
  misc_feature (433)..(433): n is a, c, g, or t
  modified_base (494)..(494): a, c, t, g, unknown or other
  misc_feature (494)..(494): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatcctttttcttggtggcagcagcaacaggtgcccactcccaggttcacctggagcagtctggacctgaggtgaagagcctggggcctcagtgaaggtctcctgcaaggcttctggctacacctttaccaccttatggtgtcaacgtgggtgcgacacggcccctggacaagggcttggagtggacgggatgggatcgagcgactttacaagtgggaacaacaaactatcgaccacagacgttcgagggacagaacgtcaccgattaccacacgacacactccaacgacgcaacacgacctaanactcggacctgaacggacgccgtaggacgtattacgacgacgacgccaatatattaactgngtacgaagtagttaggttcgggaccgtaaacggtaacttcggacttacggtcgggggaccgaacggggtaacccgtcgggacctaacccggttccgtaaccccg

SEQ ID NO: 333251 - DNA, 724 bp, Homo sapiens
  misc_feature: GZ8MTXP01EKAT9.4.23.C01.1.454.CMB.2.raw
  modified_base (268)..(268): a, c, t, g, unknown or other
  misc_feature (268)..(268): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaacgtgggtgcgacacggcccctggacaagggcttgaggtggagtgggatgggatcgagcgactttaacaagtagggaaacaacaaactatacggaccaacgagaccgttcccgaaaggggcaaggacgtaccaaccctaacttaacccaacgacgaaaccaccaactaccgaacggaacaccgaaccaacgacctaacaagttacgggaccctaggacgggacgaccggtaggtaacggtactttacggaaacggaaccgaacccgggtacctaaagttaacttaacgtttaaaccgtggttacggaaccgggtaaagggttacggtaacggtttacgggggaacccgggtaaaccgggttaaaaccgtttcgggaaacccgttaacgggttacgggggaaccccggtaacgggggtaaccccgttacgggttcccgaaccccgtttccccgg

SEQ ID NO: 333252 - DNA, 633 bp, Homo sapiens
  misc_feature: GZ8MTXP01AC2K1.4.23.C01.1.454.CMB.2.raw
  modified_base (242)..(242): a, c, t, g, unknown or other
  misc_feature (242)..(242): n is a, c, g, or t
  modified_base (355)..(355): a, c, t, g, unknown or other
  misc_feature (355)..(355): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttcnggctacacctttacacctatggtgtcaactgggtgcgacaggcccctggacaagggcttgagtggatgggatggatcgagcgcttaacgaagtgggaacacaaactatcgcanagacgtcaagggcaagagtcacgactacacagacacatccacgacgcacacgacctacatacggacctaggacggacgacccgtaggaacgtacgtttacggaaccgaaccgacgggtaccctaaagttacgttaactttacgtggttcggaacgaaggttaaggtacgtttacggggacccggtaaacgggttaaaccgttcggaaccgtttaaccggtcgggggaacccgtaacggggtaaccccgttcgggtaacccgttaacccgggttccccg

SEQ ID NO: 333253 - DNA, 613 bp, Homo sapiens
  misc_feature: GZ8MTXP01B8K97.4.23.C01.1.454.CMB.2.raw
  modified_base (242)..(242): a, c, t, g, unknown or other
  misc_feature (242)..(242): n is a, c, g, or t
  modified_base (420)..(420): a, c, t, g, unknown or other
  misc_feature (420)..(420): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaggcttcnggctacacttaccactatggtgtcaacgtgggtgcgacgacggccctggacgaagggcttgaggtggagtgggatggatcgaggcgtactttaacaagtacgggaaacaacaaactatcgacagagacgttcgaaagggcaagacgtacacctataccacagaacacactaccacgancaacacgcctacgagtacggacctaggaggacgccgtagtagtacgtttacggacgaccgacggcctaagtattaattacgtggtgaacgaagaggtaggttcgggaacccggtaacggttaaaccgttggaaccgttaacggggtcggggaaccgaaccggggtacccgttcggtaacccgaaccgttcccg

SEQ ID NO: 333254 - DNA, 530 bp, Homo sapiens
  misc_feature: GZ8MTXP01E1WEK.4.23.C01.1.454.CMB.2.raw
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (472)..(472): a, c, t, g, unknown or other
  misc_feature (472)..(472): n is a, c, g, or t
  modified_base (524)..(524): a, c, t, g, unknown or other
  misc_feature (524)..(524): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatgggatcagcgnttacaatgggaacacaaactatcgcacagacgtccgaagggcngacgtcaccataccacagacacatccacgagcacacgcctacatggaccctgaggagccgtgagtattagacgacgacggccatatattactgtgcgagagngttgggaccgacggaaccgttgactcgtggggccgacgggacccttggtccnccgtcc

SEQ ID NO: 333255 - DNA, 541 bp, Homo sapiens
  misc_feature: GZ8MTXP01CTYZ0.4.23.C01.1.454.CMB.2.raw
  modified_base (476)..(476): a, c, t, g, unknown or other
  misc_feature (476)..(476): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggctgagtggatgggatggatcgagcgctttaacaagtgggaaacaacaaactatcgacacagacgttcaagggcaagagtcaccataccacagacacataccacgagacacacgacctaacagtaggaccctgaagggacgccgtagagtattagacgacacggccaatatattacngtgcgagagagttggaccgacggaaacgttgactaagtggggcacgggaccttggtcgccgtccg

SEQ ID NO: 333256 - DNA, 533 bp, Homo sapiens
  misc_feature: GZ8MTXP01ELHCB.4.23.C01.1.454.CMB.2.raw
  modified_base (373)..(373): a, c, t, g, unknown or other
  misc_feature (373)..(373): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgctttaacaagtgggaaacacaaactatcgcacagacgttccaagggcngagtcaccattaccacagacacatccacgagcacagcctacatggacctgagagccgtgagatttgacgacgacggcaatntattactgtcgngagagtagttgggaccgaacggaaccgttgactaacgtgggccagggacccttgggtcaaccggtcc

SEQ ID NO: 333257 - DNA, 709 bp, Homo sapiens
  misc_feature: GZ8MTXP01D6RBD.4.23.C01.1.454.CMB.2.raw
  modified_base (217)..(217): a, c, t, g, unknown or other
  misc_feature (217)..(217): n is a, c, g, or t
  modified_base (270)..(270): a, c, t, g, unknown or other
  misc_feature (270)..(270): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (434)..(434): a, c, t, g, unknown or other
  misc_feature (434)..(434): n is a, c, g, or t
tcagagcactgtagcacgaccggtgctcgatttagtacacgtgattagggattggggacccaaaaaccacaccctccttgggcaatcccctagatcacagctcctcaccatggactggacctggagcattcctttttcttggtggcagcagcaacaggtgcccactcccaggttcacctggagcagtctggacctgaggtgaagagccgtgggcctnagtgaaggtctcctgcaaggtcttctggctaactacctttaccactagtggtntcaacgtgggtgcgacgacggcccctaggaacgaagggcttaggagtggagtgggatggatcgagcgtacttaaanaagtaggaaacaacaaaactanacgacaacagtacgttccgaagggacaaggactacaacctaataccaacagaacacacaccacganacaacacgacctaacagtacggacctaggaaggacgtaccggtaggtaagttaagtttacggaaccggaacgaaccggaaccgtaaattaacgttaaactttaacgttaggtacggaacggaaagggttaaaggtaaacggtttacggggaaacccgggtaaaaccggggttaaaaacccgtttcgggaaaccgttaaccggggtacgggggtaacccggtaaaccgggggaaccccgttacggggtaaccccgttaaacccgggtttaaccccg

SEQ ID NO: 333258 - DNA, 705 bp, Homo sapiens
  misc_feature: GZ8MTXP01BC4L7.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacaggcccctggacaagggcttgagtggatgggatggatcagcgctttacgaagtgggaaacacaaactatcgacaacgagaccgttccgaaaggggccaaggacgtaccaaaccctaacttaacccacaaacggaccaacaactacccaacgacgaccaacgaacgacccttaacgaactacggaaccctaggaacgggacggaccgtaggaacgtagtttacggaacgtaaccgaaccgggaccctaagttaacttaagtttaaccgttggttcggaacggaaggttaggtaacggtttcgggggaacccggtaaaccggggttaaaacccgtttcgggttaaccgttaaccgggtcgggggaaccccgtaacgggggtaaccccgttacggggttaaccccgttaacccgggtttccccg

SEQ ID NO: 333259 - DNA, 709 bp, Homo sapiens
  misc_feature: GZ8MTXP01ESECQ.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccaccttatggtgtcaacgtgggtgcgacacggcccctggacaagggcttgagtggagtgggatggatcgagcgtactttaacgaagtagggaaacaacaaaactagtaccgacaacgacgtaccgttccgaaaggggaccaaggacgtaccaaccctaacgttaacccaacacgaacacactaccaacgacgaccaacacgacctaacacgtacggaccctaggacggacgaccggtaggtaacgtagtttacggaaccgaaccgaccggtaaccctaattaacttaacgttaccgttaggttacggaacggaaggttaagggtacggttacgggggaacccggtaaaccggggttaaaccgtttcgggaaccgttaaccgggtaccgggggaacccggtaacccgggggtaaccccgttacgggttaacccgttaaccccgggtttccccg

SEQ ID NO: 333260 - DNA, 557 bp, Homo sapiens
  misc_feature: GZ8MTXP01AM45C.4.23.C01.1.454.CMB.2.raw
  modified_base (368)..(368): a, c, t, g, unknown or other
  misc_feature (368)..(368): n is a, c, g, or t
  modified_base (463)..(463): a, c, t, g, unknown or other
  misc_feature (463)..(463): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaactgggtgcgacaggcccctggacaagggcttgagtggatgggatggatcagcgcttacaatgggaacacgaaactatcgcacagacgttcaagggcngagtcacataccacagacacactccacgacgcacacgacctacacgtcggacctggacgagccgtgagtattcgacgacacggccatatattacngtgcgagagagttcggggaccgtaacggaaccgttggaccgtaacggtcgggggaaccaacggggaacccttcgggtaaccgttaacccggtcc

SEQ ID NO: 333261 - DNA, 698 bp, Homo sapiens
  misc_feature: GZ8MTXP01EI8YJ.4.23.C01.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatcctttttcttggtggcagcagcaacaggtcgcccactcccaggttcacctggagcagtctggacctgaggtgaagagccgtgggcctnagtgaagtctctgcaaggcttcngctacacctttaccactatggtgtcaacgtggtgcgacacggcccctaggacgaagggtcttggagtggagtgggatggatcgagcgtactttaacgaagtacgggaaacaacaaaactagtacgacaacgtacgaaccgtttaccgaaacggggacaacggtaacggtaccaaaccctaactttaaacccgaaccgaagaaacccaaccactaccgaacgacgacaacgacgacctaaccagtacggacctaggaaggacgaccggtaggacgttaagttacgaaccgacgaacggaccaaattacttaacgttacgttggtcgaacggaagttaggtacggtttacgggaacccggtaaacgggttaaaccgtttcggaaaccgttaacgggttacggggaacccggtaaccggggtacccgttacggggttaacccgaacccgggttaacccg

SEQ ID NO: 333262 - DNA, 626 bp, Homo sapiens
  misc_feature: GZ8MTXP01EJI0B.4.23.C01.1.454.CMB.2.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagaagccgtggggcctnagtgaaggtctcctgcaaggcttcnggctacacctttaccactatggtgtcaacgtggtgcgacacggcccctaggaacgaagggtcttggagtggagtggatggatgagtcgactttaacgaagtaggaaacaacaaaactatcgacctaacgaagtaccgttacccgaaagggaccaagggactacccaaacctaacttaacccaacaagaaccaaccactaccgaacgagacaacacgacctaacagtacgacacggaggacgcgtagagtatttacggacgacgacgactaatattaattactgtgaacgagaggtacgttagggaccgtaacggaaccgttgaccgttaacggcggggaaccgaacgggtacccgttacggtaacccgttaaccgtcccg

SEQ ID NO: 333263 - DNA, 749 bp, Homo sapiens
  misc_feature: GZ8MTXP01ET6EE.4.23.C01.1.454.CMB.2.raw
  modified_base (581)..(581): a, c, t, g, unknown or other
  misc_feature (581)..(581): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccaccttagtggtgtcaacgtgggtgcgacacggcccctggacgagggtcttgaggtggagtgggatggatcgaggcgtactttaacgaagtagggaaacaacaaactatacgacaacaggtacgttcccgaaaggggaccaaggaacgtaccaaacccgtaactttaacccgaacaacgaaccaacactaccgacggacaccaacacgaccctaagacgtacggacccgtaggaagggacgtacccggttaggtaacggtaacgtttacgggaaaccgtaaccgaccgggaccgtaacttaaattaaacgtttaccgttacgggnggtaaccggtaagggttaaaggtacgggtttaccgggggaaccccggtaaaaccggggttaaaacccgtttcggggttaaacccgttaaccgggggtaccgggggtaaccccggaaacgggggttaaaccccggttccggggttaacccgttaaccccgggtttcccg

SEQ ID NO: 333264 - DNA, 678 bp, Homo sapiens
  misc_feature: GZ8MTXP01BJR7O.4.23.C01.1.454.CMB.2.raw
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttntggctacacctttaccacctatggtntcaacgtgggtnccgacacgggcccccgtaggacgaaggtcgtaggaggtaggaggtgggagtggatcgaggcgtacttaagaaggtacggaaactaacaaacgtagtaccgacaacgacggtaccgtaccgaaagggaccaaggtacgtaccaaacctaactaacccaacgaacgaaccaactacaccgaacggacaccaacgaccgacctaacgacgtacggaccgtaggaacggacgtccgggtaaggacgttaagttacggaacgaaccgaccggtactaagttacttacttacgtgtacggaacgtaagttaggtacggttacgggaaccgtaacgttaacgttcggaacgttaacgggccggggaaccgaccgggtaccttcgggtaacccgttccggttcccg

SEQ ID NO: 333265 - DNA, 750 bp, Homo sapiens
  misc_feature: GZ8MTXP01B0WM2.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctacacctttaccacctatggtgtcaacgtgggtgcgacgaggcccctggacaagggcttgagtggagtggatggatcgagcgactttaacgaagtacgggaaacaacgaaaactagtacggaccaacgaaggtaacccgttccgaaagggggaccaaggaacgtaccaaaccgtaacttaaccccgaacgaacgaaccaacaactacccgaacgacgaccaacgacgaccctaacgacgtacggacccgtaggaacgggacgccggttaggaaggttaacgtttacggaaaccggtaaccgaaccgggaccctaaagttaacttaaacgtttaaccgttacgggttaggaaccgggtaaggttaaggtaacggtttacgggggaaacccggtaaaccggggttaaaacccgtttcgggaaacccgttaaccggggtaccgggggaaccccggtaacgggggtaaccccgttacggggtaaccccgttaacccgggtttccccg

SEQ ID NO: 333266 - DNA, 724 bp, Homo sapiens
  misc_feature: GZ8MTXP01B8MWI.4.23.C01.1.454.CMB.2.raw
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaggcttcngctacncttaccactatggtntcacgtggtgcgacaggcccctggacgaaggcttgaggtggagtgggatggatcaggcgtacttaacgaagtagggaaacaactaaactataccgacaacgaggtacccgttccgaaaggggtacaagggtacttacccaaccctaactaacccaacgaacgaccaactaactacccgaacgacgaccaacaacggaccctaacagtacggacctagggacggtacgtccgtaggtaacggtaacgtttacggaaaccgaccgaaccgggtacctaaagttaacttaacgttaccgttacggtggaaccgggtaaggttaaacgggtacggttacgggggaacccgggtaaacccgggttaaaacccgttttcgggaaacccgtttaacgggacccgggggtaacccggtaaaccgggggtaccccgttacgggggtaacccttaaccccggggtttccccg

SEQ ID NO: 333267 - DNA, 676 bp, Homo sapiens
  misc_feature: GZ8MTXP01EA19S.4.23.C01.1.454.CMB.2.raw
  modified_base (220)..(220): a, c, t, g, unknown or other
  misc_feature (220)..(220): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagccgtggggcctnagtgaggtctcctgcaaggcttcgtgctacacctttaccaccttagtggtntcaacgtgggtncgacgacggcccctggacaagggcttggagtggagtgggatggatcgagcgtacttaacgaagtaggaaacacaaacgtataccgacaacagtaccgtccgaaaggggcaaggaacgtacaacctaactaacccaacgagaaccaacactacccgaacgacgaccaacgtaacgacctaacgacgtacggacccgtaggaaacgggtacggaccgttaggaagttaacgtttacggaaccgaaccgaccgggtaccctaaagttattaagttaaccgttggtagtaacggaagagggtacgtttacggggaccgtaaacgggttaaaccgttggaccgtaagggtccggggaaccgtaacgggacccgttacggtcccgttaaccggttcccg

SEQ ID NO: 333268 - DNA, 687 bp, Homo sapiens
  misc_feature: GZ8MTXP01BWMT0.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggtcttctggctactacctttaccacctatggtgtcaacgtgggtgcgacacggcccctggacaagggcttagagtggagtgggatggatcgagcgtacttaacaagtgggaaacaacgaaactatcgacacgaggtacccgttaccgaaaggggcaaggacgtaccaacccgtaacttaacccaacgaacgaaccctaacaactacccgaacgacgaccaacacgaccctacgacgtacggacctaggacggacgtaccggtaggtaacgttacgtttacggaaccgtaaccgaccggtacctaagttacttaacgttaccgtgttacggaacggaaggttaggtacggttacggggaacccgtaacgggttaaaccgttcggaaccgtaaccgggtcgggggaacccgtaacggggtaccccgttacggtcccgttaacccgttccccg

SEQ ID NO: 333269 - DNA, 552 bp, Homo sapiens
  misc_feature: GZ8MTXP01AW3SU.4.23.C01.1.454.CMB.2.raw
  modified_base (326)..(326): a, c, t, g, unknown or other
  misc_feature (326)..(326): n is a, c, g, or t
  modified_base (369)..(369): a, c, t, g, unknown or other
  misc_feature (369)..(369): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggccctggacaagggcttgagtggatgggatggatcgagcgnttacaatgggaacacaaactatcgcacagacgttccaagggcngagtcacatacacagacacatccacgagcacagacctacactcgggacctggaggacgaccgtgagtatttacggacgacgacggccatatattactgtgcgagagagttgggacccgtaacggaacccgttgacgtaacgtgggggaaccacgggggaacccttcgggtccgaaccggttcc

SEQ ID NO: 333270 - DNA, 624 bp, Homo sapiens
  misc_feature: GZ8MTXP01D7GE2.4.23.C01.1.454.CMB.2.raw
  modified_base (243)..(243): a, c, t, g, unknown or other
  misc_feature (243)..(243): n is a, c, g, or t
tcagagcactgtagcacgaccggtgctcgatttagtacacgtgattagggattggggacccaaaaaccacaccctccttgggcgaatcccctagatcacagctcctcaccatggactggacctggagcatcctttttcttggtggcagcagcaacaggtgcccactcccaggttcacctggagcagtctggacctgaggtgaagagccgtgggcctcagtgaaggtctcctgcaaggtcttcnggctactacctttacaccttatggtgtcaacgtgggtgcgacgacggccccgtaggaacgaaagggtcttaggaggtgggagtggggagtggactcgagcgtactttaacaagtaggaaacaaacgaaatatcgacacgaaggaccgttacgaaagggaccaaggactacaacccaattaacccaacgacgaacacacaccaacgagacaacacgacctaacagtacgacctaggaacgagtaccgtagacggttattacggaacgacgacggactaatataagttacgtgtgaacgtaagagtacgttacgggaccgtaacgaacgttgaccgttggacgggaaccgaacgggacccgttcgtaaccgttaaccggtccc

SEQ ID NO: 333271 - DNA, 617 bp, Homo sapiens
  misc_feature: GZ8MTXP01A7KQ7.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcgagtgaaggtctcctgcaaggtcttcgtggctactacctttaccaccttagtggtgtacaacgtgggtcgcgacgacggcccctaggacgaaggcttgagtggagtggatggatcgagcgtactttaacgaagtacgggaaacaactaaactagtacgaccaacgacggtaccgttccgaaagggccaaggacgtaccaacctactacccaacacgaaccacactaccgaacgacaccaacacgacctacagtacggacctagacggacgccgtagacggtattacgaacgacgacgacatatatactgcgaagagagtacgttcgggaccgtaacgttaacgttgaacgtaacggtcgggaaccgaacgggacccgttcgggtccttaaccggtcccg

SEQ ID NO: 333272 - DNA, 643 bp, Homo sapiens
  misc_feature: GZ8MTXP01DO9EP.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaactgggtgcgacaggcccctggacaagggcttgagtggatgggatgggatcgagcgactttaacaagtgggaaacacaaactatcgacacagaccgttcccaaaggggcaaggagtccaaccattaacccacagaacacatccaacgagacaacaacgcctaacagtacggaaccctggaaacgggacgacccggttaggaagtaacgtttacggaaccgaacgtaaccgggacctaaattattaaactttacgtggttagaacggaagaggtacgttacggggacccgtaacgggaaaaccgtttggaaaccgttaacggtacgggggaaccgtaacggggaaccccgttgggtcccgttaacccggttccc

SEQ ID NO: 333273 - DNA, 609 bp, Homo sapiens
  misc_feature: GZ8MTXP01B33L3.4.23.C01.1.454.CMB.2.raw
  modified_base (399)..(399): a, c, t, g, unknown or other
  misc_feature (399)..(399): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacacggcccctggacgaagggcttgagtggagtggatggatcagcgcttacaagtggaaacacaaactatcgacacgagacgttccgaagggcaaggtagtaccaccacttaccaanagaaccacataccaacgacgccaacacgacctacgagtacggacctaggaggacgcgtagagtacttacgacgacgaccggaccaatattaattactggtgtaacggaagacggtgttacgggacccgtaacgggttaaacccgttggaacgttaaccggtacgggggcccgtaacggggtacccgttcggtaacccgaacccgttcccg

SEQ ID NO: 333274 - DNA, 553 bp, Homo sapiens
  misc_feature: GZ8MTXP01BIYOZ.4.23.C01.1.454.CMB.2.raw
  modified_base (238)..(238): a, c, t, g, unknown or other
  misc_feature (238)..(238): n is a, c, g, or t
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (456)..(456): a, c, t, g, unknown or other
  misc_feature (456)..(456): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctcagtgaagtctctgcaaggcttngctacacctttacactatggtgtcaagtggtgcgacacggcccctggacaagggcttgagtggatgggatggatcagcgcttanaagtgggaacacaaatntcgcagagacgtcaagggcngagtcacgattaccanagacacatcccagacgacacagcctacagtacggacctggagagccgtagagtattcgacgacgacggccagtatattacngtgcgagaggtacgttgggacccgtaacggaaccgttcgaaccgtaacggtcggggaaccgtacgggggtaacccttcggggtccaacccggtcccg

SEQ ID NO: 333275 - DNA, 657 bp, Homo sapiens
  misc_feature: GZ8MTXP01ACY01.4.23.C01.1.454.CMB.2.raw
  modified_base (242)..(242): a, c, t, g, unknown or other
  misc_feature (242)..(242): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttcnggctacacctttaccacctatggtgtcaacgtgggtgcgacaggcccctggacaagggcttggagtgggatgggatgggatcgaggcgtactttaacgaagtgggaaacaacgaaactatcgacacagaccgttccgaaggggcaagagtccacacttaccacacgacacatccacgacgcacacgacctacagtcggacctggacggacgccggtaggagtagtttacggaaccgacgaaccggacctaagtacttaacgtttacgtacggttgggtaacggaaggttaacgggtaaggtttacgggggaaccccgggtaaacgggttaaaccccgtttggaaccggttaaccgggtacgggggaaccgtaaccgggggtaacccgttcgggtaacccgttaacccggttcccg

SEQ ID NO: 333276 - DNA, 724 bp, Homo sapiens
  misc_feature: GZ8MTXP01D4PTR.4.23.C01.1.454.CMB.2.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcgtgggctgagtgagtctctgacagcttngctacacttacactatgtntcacgtggtgcgacacggtcccgtggacgaaggtctgaggtggagtggagtggtactcgagcgtactttaacgaagtagggaaccaaacgaaactagtacgacaacgagtacccgttaccgaacggggactaaggtacgtacccaaaccctaacttaacccaacgaagaccaacactacccgaacggacgaaccaacgaacggtaccctaacgtacggtaccggaacccgttagggaacgggacgtacccggtaaggtaaggttaaccgttttacgggaaaccgtaacccggaccgggtaaccctaaattaacttaaacgtttaaccggtggttaccggaacggtaacggttaggttacgggtttaccggggaaccgggttaacccgggttaaaacgttcgttaaaccggtcgggtaccggggaacccgtaacgggtaccccgttcggtaaccgttaacccggtttcccg

SEQ ID NO: 333277 - DNA, 624 bp, Homo sapiens
  misc_feature: GZ8MTXP01BPKN3.4.23.C01.1.454.CMB.2.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (439)..(439): a, c, t, g, unknown or other
  misc_feature (439)..(439): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtgggcctnagtgaggtctctgcaaggcttnggctactacctttacaccttatggtgtctaacgtgggtcgcgacacggccctaggacgaagggcttggagtggagtgggatggatcgagcgactttaacgaagtgggaaacaacaaactagtcgacacgaggtaccgttaccgaaagggtacaaggtacgtaccaacctacgtaacccacgacgacacactaccagacncaacacgctacacgtcgaccgtgaacggtcaccggtagagtacttacggaacgaccgacggcctaagtactagttacgtgtacggaacgaagcggtagttcggggaccgtaacggttaaacgttgaaccggtaacgtcggggaaccgaacggggtacccgttcgggtaaccttaaccggttcccg

SEQ ID NO: 333278 - DNA, 569 bp, Homo sapiens
  misc_feature: GZ8MTXP01DUK29.4.23.C01.1.454.CMB.2.raw
  modified_base (237)..(237): a, c, t, g, unknown or other
  misc_feature (237)..(237): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctcagtgaggtctctgcaggcttntggctacacctttaccacctatggtgtcaacgtggtgcgacacggcccctaggacaaggcttgaggtggatgggatggatcgagcgtacttaacaagtagggaaacacaaactatcgacacgagtacgtcgaagggcaagagtcacataccacagacacataccacgagacacacgacctacatcggacctgagacgcgtagagtattagacgacgacggacatatattacgtgtgaacgagagtagttacgggaccgtaacggttaaaccgttgacgtaacggtacggggaaccgaacggggtacccgttcggtaaccgttccgttaaccg

SEQ ID NO: 333279 - DNA, 721 bp, Homo sapiens
  misc_feature: GZ8MTXP01EU6B2.4.23.C01.1.454.CMB.2.raw
  modified_base (218)..(218): a, c, t, g, unknown or other
  misc_feature (218)..(218): n is a, c, g, or t
  modified_base (267)..(267): a, c, t, g, unknown or other
  misc_feature (267)..(267): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctnagtgaaggtctcctgcaaggcttctggctacacctttaccactatggtntcaacgtgggtgcgacacggccctggacaagggcttgaggtggagtgggatggatcgagcgcttaacgaagtagggaacaacgaaactatcgacacgagacgttaccgaagggcaaggacgtacaacctaacttaacccaacacgaacaactactacccgaacgacgaccaactaacgcccttaacaacgttcggaacccgttaggaacgggtacgtaccggttaggtaacggttaacgtttacgggaaaccggtacccgaaccggggtaaccccgtaaagttaacttaaacgttttaccgtacggttagggaaccggtaacgggaaggttaacgggtttcggggaacccgggtaaaccgggttaaaaccgttcgggttaacccgttaacgggtcgggggaaccccgtaacgggggaaaccccgttcgggtaacccgttaaccccggtttcccg

SEQ ID NO: 333280 - DNA, 739 bp, Homo sapiens
  misc_feature: GZ8MTXP01EEYVJ.4.23.C01.1.454.CMB.2.raw
  modified_base (243)..(243): a, c, t, g, unknown or other
  misc_feature (243)..(243): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagccgtgggcctcagtgaaggtctcctgcaaggcttntggctacaccttaccacctagtggtgtcaacgtgggtgcgacacggcccccgtaggaacgaaggtcgtaggaggtggaggtggagtagggactacgaggtcgtactttaaagaaggtacggaaaccaaacaaaacttagaccgaccaacggtaacgtaccgttaccggaacgggacaaggaccgtaccaacctaacttaaccaacgaacgaccaacactaccgagacgaccaacgacgtaccctaagcgtaacgacccagggaaggtaccgtccgggtaagtaacgtttagttacgaaccgaacccgacggtacctaaagtttacttaaccgttacgtaggtcggaaggtaaggttaagggtacggttaccgggggaaacccggtaaaacccgggttaaacccggttgttaaaaccccgggttcgggggaacccggggaacccggtaaaacccggggtcccgttaccggtaaccccgttcccgggtttaacccccg

SEQ ID NO: 333281 - DNA, 662 bp, Homo sapiens
  misc_feature: GZ8MTXP01EJ0V3.4.23.C01.1.454.CMB.2.raw
  modified_base (344)..(344): a, c, t, g, unknown or other
  misc_feature (344)..(344): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcaggtgaaggtctcctgcaaggcttctggctacacctttaccaccttatggtgtcaacgtgggtgcgacgacggcccctggaacgaagggcttggaggtggagtgggatggatcgagcgtacttanaagtggaaacacgaaactatcgacacgagtacgttccgaagggaccaaggacgtccaaaccgtactaaccacaagaacacaactaccgaacgacgacaacgacgacctaacacgtacggacctaggaacggacgaccgtaggacgtagtttacggaaccgaacgaaccggtaccaaagttaattacgttaacgtggttcgaacggaagttaggtacgttacggggacccgtaaacgggttaaacccgttggaaccgttaaccggtacggggaacccgtaacggggacccgttcgggtaacccttaaccggtttccccg

SEQ ID NO: 333282 - DNA, 638 bp, Homo sapiens
  misc_feature: GZ8MTXP01EF1EK.4.23.C01.1.454.CMB.2.raw
  modified_base (240)..(240): a, c, t, g, unknown or other
  misc_feature (240)..(240): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtggggcctcagtgaaggtctctgcagcttngctacaccttacacctatggtgtcaacgtggtgcgacacggccctaggacgagggcttggagtggagtgggatggatcgagcgctttaacaagtggaaacaacaaactagtcgacaacgagtaccgttcccgaaggggacaaggtacgtacccgaaaccctaacttaaccccgaacaacgaaccaaccaactacccgaacgacgaccaacgaaccgtacctaacgacgtacggaccgtaggaacggacgtccgtagtacgtagttacgacgacgacgtacaattatattacgtgtgaacgtaggagtaggttacgggacgtaaccggttaaccgttggaccgttaacgggtacggggaaccgaacggggtaacccgttcggtccgaaccggtttcccg

SEQ ID NO: 333283 - DNA, 712 bp, Homo sapiens
  misc_feature: GZ8MTXP01A6K25.4.23.C01.1.454.CMB.2.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctnagtgaaggtctctgcaaggcttnggctacacctttaccacctatggtgtcaacgtgggtgcgacgaggcccctggacaagggcttgagtggatgggatggatcgagcgcttaacgaagtcgggaaacaacgaaaactagtacgaccaacgagtaaccggttcccgaaagggggccaaggtaacggtacccaaacccgtaactttaacccaacgaaacgaaccaacaactacccaaacggacgaccaacaacggacccttaacgaacgtacgggaccctagggaacgggacgaccggttaggaacgtagtttacggaacgtaaccgaccgggacctaattaacttaattaaccgttggtaggaaccggtaaggaacggtacggtttcgggggaacccgtaacggggttaaaacccgtttgggaaccgttaaccgggtcgggggaacccgtaaacgggggtaaccccgttgggtaacccgaacccgggtttccccg

SEQ ID NO: 333284 - DNA, 702 bp, Homo sapiens
  misc_feature: GZ8MTXP01AH5XI.4.23.C01.1.454.CMB.2.raw
  modified_base (338)..(338): a, c, t, g, unknown or other
  misc_feature (338)..(338): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtgggtgcgacgacggcccctggacgaagggcttgaggtggagtgggatggatcgagcgactttanaagtaggaaacacaaactatcgacacgtaggaccgttaccgaaggggtccaaggtacgtaccgaacctaacttaacccgacgaacgaaccaacctacgtacccgaacggaacgaccaaccaacggacccttaacgaacgtcgggaacccgttagggaacgggtacggtacccgtaggtaacgtacgtttacggaaccggaaccgtaccggggaccctaataagttacttacgtaggtcgaacgaggttacggtaggttcgggaacccggtaacgggttaaaccgttcggaccggttaacgggttcgggggaacccgtaacggggtaccccgttacggggttcccttaacccgggtttaaccccg

SEQ ID NO: 333285 - DNA, 606 bp, Homo sapiens
  misc_feature: GZ8MTXP01DBHJZ.4.23.C01.1.454.CMB.2.raw
  modified_base (363)..(363): a, c, t, g, unknown or other
  misc_feature (363)..(363): n is a, c, g, or t
  modified_base (539)..(539): a, c, t, g, unknown or other
  misc_feature (539)..(539): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtggggcctcagtgaaggtctcctgcaaggcttctggctacacctttaccacctatggtgtcaacgtgggtgcgacacggcccctggacaagggcttggagtgggatggggatgggatcgagcgtactttaacgaagtgggaaacaacaaactntacgacacgagtaccgttcccgaaaggggcaaggacgtaccaccctaacttacccacacgaaccacactacccaacgagaccaacgaacgccctaacacgtcggaccgtaggacggacgccggtaggaagtatttacggacgaccgacggacctaattatattactgtgaacgagngtagttcgggaccgtacggttaacttgacgtcggtacgggcgacgggtacccttggtccgccgttcc

SEQ ID NO: 333286 - DNA, 695 bp, Homo sapiens
  misc_feature: GZ8MTXP01EPGXZ.4.23.C01.1.454.CMB.2.raw
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtcgcccactcccaggttcacctggagcagtctggacctgaggtgaagagcgtgggcctnagtgagtctctgcagtcttcngctactaccttacactatgtntcagtggtncgacncggccctaggacgagggtcttaggagtggagtgggatggatcgagtcgtacctttaagaaggtacgggaaaccaacgtaaactagtaccgacaacgaacggtaccgttaccggaaagggacaaggtacgtaccaaaccgtactaaacccagaacaacacaacaccaacggaacacaacgtaacgacctaacgacgtacgggaaccgtaggaacggacgtaccgggtaaggtacgtaacgtttacggaaccgtaacgaaccggtacctaaagttaattaacttaacgtcggtaggaacggtaaggttaacgggtacggttacggggaaccggtaacggttaaaaccgttcggaaccgttaacggggtacgggaacccggtaacggggaccccgttacggtaacccgttaacccgtttcccg

SEQ ID NO: 333287 - DNA, 611 bp, Homo sapiens
  misc_feature: GZ8MTXP01DZ6VA.4.23.C01.1.454.CMB.2.raw
  modified_base (244)..(244): a, c, t, g, unknown or other
  misc_feature (244)..(244): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttcnggctacacctttaccacttatggtgtcaacgtgggtgcgacacggcccctggacaagggtcttgagtggagtgggatggatcgagcgtactttaacgaagtgggaaacaacgaaaactatacggacaacgacgtaccgttaccgaaagggacaacggagtaccaaccctaagttaacccaacgaacgacaacactaccaacgagaccaacacgacctaacagtacggaactggaacggacgccgtagagtatttggaaccgacgacggcaatactattactgtcgaagagagtagttcgggacgaacggttaaacgttgacgtggtacgggccgtaacgggaccgttacggtcccgttaacgtcccg

SEQ ID NO: 333288 - DNA, 704 bp, Homo sapiens
  misc_feature: GZ8MTXP01EEO10.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatcctttttcttggtggcagcagcaacaggtgcccactcccaggttcacctggagcagtctggacctgaggtgaagaagccgtggggcctcagtgaaggtctcctgcaaggcttctggctacacctttaccactatggtgtcaactgggtgcgacacggcccctggacaaagggcttgagtggatgggatggatcagcgctttaacaagtagggaaacaacgaaaactatacgcaacaggacgtttcccgaaaggggacaaggaacgtcaaaccctaattaaacccacaacgaacacactaccaacgaagaccaacaacgaccctaacagtacggacccgtggaagggacgaccgttaggaagtaagtttacggaacgaacgaaccgggacctaaattaacttaactttaacgtgggtagaacggtaaaggaaaggtacggtttacgggggaaccccggtaaaaccggggttaaaaaccctttgggttaaacccgttaaccggggttacggggggaaccccgaaacgggggtaaccccgttacggggtttaacccgaaccccgggtttaaccccg

SEQ ID NO: 333289 - DNA, 808 bp, Homo sapiens
  misc_feature: GZ8MTXP01CJMLT.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctacacctttaccacctatggtgtcaacgtgggtgcgacacggcccctggacgaagggcttggagtggagtgggatgggatcgagcgtactttaacgaagtagggaaacaacgaaactagtaccgaccaacgtaacggtaaccgtttacccggaaacgggggactaacgggaacgtaaccctaaacccgtaaacgtttaacccccgaaacgaaacggtaaacccaaccgtaaaccgttaccccgaaaccggaacggaacccaaaccgaacggtaccccttaaacgacgttaccgggaacccgttagggaacgggtaacgtcccggttaggaacggttaacgtttacgggaacccgaaccgtaacccgggacctaaagttaacgttaacgtttaaccgtggttacggaaccggtaaggaacgggtaacgggttaccggggtaaacccggtaaccgggttaaaacccgtttcgggaaacccggttaaccggggttaccgggggaacccggtaaccgggggtaaccccgttacggggtaaccccgttaaccccggtttaaccccg

SEQ ID NO: 333290 - DNA, 699 bp, Homo sapiens
  misc_feature: GZ8MTXP01AYJR3.4.23.C01.1.454.CMB.2.raw
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctnagtgaaggtctcctgcaaggcttcnggctacacctttacacctatggtntcaactggtgcgacaggcccctggacaggcttgagtggagtgggatggatcgagcgactttacaagtgggaaacacgaaacgtatacgacaacgaggaccggttcccgaaaggggacaaggaacgttaccgaaccaacttaacccaacgaacgaaccaaccaactacccgaacgacgaccacacggacccttacacgtacgggaacccgtggaacgggacgacccggttagaacgtaacgtttacggaaccggtaacgaccgggtacctaataacttacgtttaacgtggttacggaacggtaaaggttacggttaaacggttcgggggaaacccggtaaccgggttaaacccgtttcggaacccgtttaacggggtacgggggaacccgtaaacgggggtaccccgttagggtcccgttaacccgtttccccg

SEQ ID NO: 333291 - DNA, 665 bp, Homo sapiens
  misc_feature: GZ8MTXP01CBHDB.4.23.C01.1.454.CMB.2.raw
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctacacctttaccacctatggtntcaactgggtncgacncggcccctggacagggcttgagtggagtgggatggatcgagcgtacttaacgaagtagggaaacaacaaactatcgacacacggtaccgtaccgaagggaccaaggacgtaccaaccgtactaccacacgacacactaccgaacgacgaccaaccgaacgaccctaactacgtacgggacccgtagggacggacggtaccgtaggtaacgttacgtttacggaaccgaaccgaccggacctaagttacttaatttaacgtgtggaacgaaggttaggtacggttacggggaccggtaacgggttaaaaccgtttcgggaccgtaacgggtcgggggtaaccgaaccggggtacccgttagggtccccgaaccggttcccg

SEQ ID NO: 333292 - DNA, 572 bp, Homo sapiens
  misc_feature: GZ8MTXP01CKIRU.4.23.C01.1.454.CMB.2.raw
  modified_base (217)..(217): a, c, t, g, unknown or other
  misc_feature (217)..(217): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (468)..(468): a, c, t, g, unknown or other
  misc_feature (468)..(468): n is a, c, g, or t
  modified_base (500)..(500): a, c, t, g, unknown or other
  misc_feature (500)..(500): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttctggtggcagcagcaacaggtgcccactcccaggttcacctggagcagtctggacctgaggtgaagaagcctggggcctnagtgaaggtctcctgcaaggtcttctggctacacctttaccacctagtggtgtcaacgtgggtgcgacaggcccctggacaagggcttgagtggatggatgggatcgagcgntttacaagtgggaaacacaaactatcgacanagacgttccgaaagggccaagagtacaccattaccgacagacactanaccacgacgacacacgtacctanagtcggacctggacggagccgtggagtacttcggaacnccgaacggccaatactattactgtgcgaaggngtagttcgggaccgaggttaaaccgttgacgtaagtcgggaaccgaggggaacccttgggtccaacggttcc

SEQ ID NO: 333293 - DNA, 710 bp, Homo sapiens
  misc_feature: GZ8MTXP01EMKSG.4.23.C01.1.454.CMB.2.raw
  modified_base (216)..(216): a, c, t, g, unknown or other
  misc_feature (216)..(216): n is a, c, g, or t
  modified_base (266)..(266): a, c, t, g, unknown or other
  misc_feature (266)..(266): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctnagtgaaggtctcctgcaaggcttctggctacacctttaccacctatggtntcaacgtgggtgcgacacggcccctaggacgaagggtcttggagtggagtgggatggatcgagcgtactttaacgaagtagggaaaccaacaaaactagtacgacaacgagtaccgttaccgaaaggggcaaggacgtaccaaaccctaacttaacccaacgacgaaccacaactacccgaacggacgaccaacaacgaccctaacgacgtacgggaccctagggaacggtacgaccggttaggacgttaagtttacggaacgtaaccgaccggtacctaaattaattaacgttaaccgtcggtggaacggaaggttaacggtacgggtttacggggaaccccggtaaacgggttaaaaccgttcggaaaccgttaaccgggtacggggaacccggtaacggggtaccccgttacggggtaaccccttaacccgggttaacccg

SEQ ID NO: 333294 - DNA, 715 bp, Homo sapiens
  misc_feature: GZ8MTXP01EIMH4.4.23.C01.1.454.CMB.2.raw
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
tcagagcactgtagcacgaccggtgctcgatttagtacacgtgattagggattggggacccaaaaaccacaccctccttgggcgaatcccctagatcacagctcctcaccatggactggacctggagcattcctttttcttggtggcagcagcaacaggtcgcccactcccaggttcacctggagcagtctggacctgaggtgaagagccgtgggcctnagtgaagtctctgcaaggcttngctacactttacactanggtntcaacgtgggtncgacacggccctaggacaagggcttgagtggagtgggatggatcagtcgactttaacaagtagggaaacaacaaaactatacggacaacgaagtaccgttacccgaaaggggaccaagggtacttacccaaacctaaacttaaccccgaaacgaacgtaaccaactaacctaaccgaaacggaacgaaccgaaccgtaacgtaacctaacgaacgtacggaaccgtaaggaacggtacgtacggttaggtaacgttaacgttacggaaccgtaaccgaccgtaacttaaattaacgttaacgttacgtacggtaggaacggtaaggttaacggtacggttaccggggaaccggtaaacggttaaaccgttcggttaaccggtaaccgggtacggggtaacccgtaacgggtacccgttacggtaacccgttaaccgttccg

SEQ ID NO: 333295 - DNA, 639 bp, Homo sapiens
  misc_feature: GZ8MTXP01EIVPN.4.23.C01.1.454.CMB.2.raw
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtgggcctcagtgagtctctgcaggcttctgctacaccttacactangtgtcacgtggtgcgacncggccctaggacaaggcttgagtggagtggatggatcgagcgtactttaacgaagtacggaaacaacgaaactagtacgacaacgagtaccgttccgaaagggcaaggtactacccaacctaacgttaaacccacgaacgaaccactaactacccgaacgacgaccaacgaacgacctaacagacggacctaggaacggacgccgtagacgtaattacggacgacgtaccggactaagttatattacgtgtacgaacggaagagtacggttacggggaccgtaaacggttaaaccgttgaaaccggtaacgggaccggggtaaccgaaccggggtaccgttcgggttaacccgaacccggttcccg

SEQ ID NO: 333296 - DNA, 682 bp, Homo sapiens
  misc_feature: GZ8MTXP01DQTNQ.4.23.C01.1.454.CMB.2.raw
  modified_base (267)..(267): a, c, t, g, unknown or other
  misc_feature (267)..(267): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttacacctatggtntcaactggtgcgacaggcccctggacaagggcttgagtggatggatggatcagcgctttaacaagtgggaaacaacgaaacgtatcgaccaacgagtaaccgttccgaaaggggaccaaggaacgtaccaaaccctaacttaacccaacgaagaaccacaactaccacggagacaaccaacgaccctaacacgttacggaacccgtggaacgggtacgacccgggtttacgaaggtaagtttacggaaaccgtaacgaaccggggacctaaagttacttaacgttaagtcgttgaacgaaggttagtaggttacggggacccgtaacgggttaaaacccgttggttaaaacgttaacggaacgggggaacccgtaacggggtaccccgttagggtccccgttaaccggttccccg

SEQ ID NO: 333297 - DNA, 529 bp, Homo sapiens
  misc_feature: GZ8MTXP01ERJEV.4.23.C01.1.454.CMB.2.raw
  modified_base (425)..(425): a, c, t, g, unknown or other
  misc_feature (425)..(425): n is a, c, g, or t
  modified_base (515)..(515): a, c, t, g, unknown or other
  misc_feature (515)..(515): n is a, c, g, or t
tcagagcactgtagcacgaccggtgctcgatttagtacacgtgattagggattggggacccaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgctttacaatggaacacaaactatcgcacagacgttccaagggcaagagtcaccattaaccacagacacataccacgagacacagcctacatcggactgagngcgtgagattcgacgacgacggcatatatactgtgcgagagagttcgggccgaacggaaccgttggactaacgtgggccgagggtacccnggtccaaccggtcc

SEQ ID NO: 333298 - DNA, 657 bp, Homo sapiens
  misc_feature: GZ8MTXP01BHZ2Q.4.23.C01.1.454.CMB.2.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctnagtgaaggtctctgcaggcttcnggctacaccttacactatggtgtcacgtgggtncgacacggcccctggacgaaggcttggaggtggagtgggatggatcgaggcgtctttaacgaagtacggggaaacaacaaacgtagtcgaccacgacggtaacgttcccgaaagggacaagtacgtcaaaccctacttaaccacagaaccaccactacccaacgacgaccaacacggaccctaagacgtacgggacctaggacgggacgccggtagaacgtagttacgaacgacgacggacctaatatacgttactggtcgaacggaggttaggtacggttacgggaccggtaaaccggttaaaccgttcggaacgttaaccgggggtcggggaacccggtaacggggtaaccccgttcgggtaacccgttaacccggttccg

SEQ ID NO: 333299 - DNA, 692 bp, Homo sapiens
  misc_feature: GZ8MTXP01CSE81.4.23.C01.1.454.CMB.2.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
tcagagcactgtagcacgaccggtgctcgatttagtacacgtgattaggggattggggacccaaaaaccacacccctccttgggcgaatcccctagatcacagctcctcaccatggactggacctggagcatcctttttcttggtggcagcagcaacaggtgcccactcccaggttcacctggagcagtctggacctgaggtgaagagcctgggcctnagtgaggtctctgcaggcttnggctacacttacactatggtntcacgtggtncgacncggccctggacagggcttgagtggagtgggatggatcgagtcgtactttaacgaagtacggaaacaactaaactatcgacacgagtaccgttcccgaaggggtccaaggtacgtaccaaacctactaacccgacaacgaaccacaactacccgaacgacgacctaaccgacgacccttaacgacgtacgggacccgtagggaacggacgtaccggtaggtaacgttacgtttacgggaaccgtaaccgaccggtacctaagttaacttaacgttaacgtggttacggaacggtaagttaagggtacggttcgggggaaacccgtaacgggttaaaccgttcgggaaccggttaaccgggtacgggggaaccgtaacgggggtaaccccgttcgggtaacccgttaacccggttcccg

SEQ ID NO: 333300 - DNA, 658 bp, Homo sapiens
  misc_feature: GZ8MTXP01AX47Z.4.23.C01.1.454.CMB.2.raw
  modified_base (382)..(382): a, c, t, g, unknown or other
  misc_feature (382)..(382): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacaggcccctggacaagggcttgagtggatgggatgggatcgaggcgtactttaacgaagtgggaaacacgaaactatcgacacagacgttcgaagggcngagtcaccattaccacagacacatccacgagcacacgcctaacacgtcggacctggaacgggacgcccggttaggaacgtaagtttacggaaccgtacgaaccgggaccctaaattactaactttaccgtacggttggaaccggtaaggaacgggtaacgtttcgggggaaaccccggtaaacgggttaaaacccgtttgggaacccgtaaccgggttcgggggaaccccgaacgggggtaaacccccgttgggtaacccgttaacccggttcccg

SEQ ID NO: 333301 - DNA, 546 bp, Homo sapiens
  misc_feature: GZ8MTXP01AQ69P.4.23.C01.1.454.CMB.2.raw
  modified_base (509)..(509): a, c, t, g, unknown or other
  misc_feature (509)..(509): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttaacaatgggaacacaaactatcgacacagacgttccaagggcaagagtcaccattaccacagacacatccacgagcacagcctacatcggacctgagagccgtgacgtatttggaacgacgacggccagtatatactgtgcgagagagttcgggacgaacggaaaccgttgaccttaacgnggggaacccgagggaccccttgggtccaaccggttcc

SEQ ID NO: 333302 - DNA, 687 bp, Homo sapiens
  misc_feature: GZ8MTXP01C123K.4.23.C01.1.454.CMB.2.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (259)..(259): a, c, t, g, unknown or other
  misc_feature (259)..(259): n is a, c, g, or t
tcagagcactgtagcacgaccggtgctcgatttagtacacgtgattaggggattggggacccaaaaaccacacccctccttgggcgaatcccctagatcacagctcctcaccatggactggacctggagcatcctttttcttggtggcagcagcaacaggtgcccactcccaggttcacctggagcagtctggacctgaggtgaagagccgtgggctgagtgaggtcnctgcagctngctacacttactacctatggtntcaacgtgggtgcgacgacggcccctggacgaagggcttggagtggagtgggatgggatcgagcgtactttaacgaagttagggaaacaacgaaactagtacgacaacgagtaccgttacccgaaaggggcaaggacgtccaaaccgtacttacccacaacgacaacactaccgaacgacgacaaccgacgtaccctaacgacgtacgggacctagggaacgggacgtaccggttaggaacggttacgtttacggaaccgtaaccgaccgggacctaaacgttattaaacttaccgtggttacggaacggtaaggttaacggtacgttacggggaacccggtaacggttaaaaccgttgaaccggtaacggtccgggggaacccgtaacggggtaccccgttcgggttaaccgttcccggttaacccg

SEQ ID NO: 333303 - DNA, 668 bp, Homo sapiens
  misc_feature: GZ8MTXP01BWZV3.4.23.C01.1.454.CMB.2.raw
  modified_base (270)..(270): a, c, t, g, unknown or other
  misc_feature (270)..(270): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctactacctttaccaccttatggtntcaacgtgggtgcgacacggcccctggacaagggcttggagtggagtgggatgggatcgagcgtctttaacgaagtgggaaacaacgaaactagtcgacacgaagtaccgttcccgaaaggggccctaagggaacgtaccaaacccgtaacttaacccaacgacgaaaccaaccaactacccgaacgacgaccaacgacgaccctaacacgtacggaccgtaggaacgggacgccgtaggaacgtagtttacggaaccgaaccgacggacctaattataacgttacgtgtcggaacggtaggagtaggttacggggacccggtaacggttaaccgttcggaccgtaacgggtcggggaaccgtaacggggtacccgttcgggtcccgaaccgttcccg

SEQ ID NO: 333304 - DNA, 592 bp, Homo sapiens
  misc_feature: GZ8MTXP01AOAG9.4.23.C01.1.454.CMB.2.raw
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (360)..(360): a, c, t, g, unknown or other
  misc_feature (360)..(360): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttcnggctacacctttaccaccttatggtntcaacgtgggtncgacacggcccctggaccaagggtcttgagtggatgggatggatcgagcgactttaacgaagtacggaaacacaaactntacgacacgagtaccgttacgaagggacaagacgtacacctataccacacgacacactccgagacgacacacgacctaacagtcggacctggacggacgccgtagagtagttacgaacgacgacggccaatatacttacgtgtgcgaagagtacgttcgggaccgaacggttaacgttggaccgtaacggtcggggaaccgacgggtaacccgttggtaaccgaaccggtcc

SEQ ID NO: 333305 - DNA, 696 bp, Homo sapiens
  misc_feature: GZ8MTXP01CIB7Z.4.23.C01.1.454.CMB.2.raw
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtntcaacgtgggtncgacaggccctggacagggcttgagtggatgggatggatcgagcgtactttacgaagtcgggaaactaacaaacttatacggacctaacgaggtaccgttacccgaaggggtaccaaggacggtacccaaccgtaacttaacccgacaacgaacctaacactacccgaacggacgacctaacgacgtaccctaacgaacgtcggaaccctagggaacggacgtaccgtaggtaacggtacgtttacggaaccgtaaccgaccgggtaccctaagttaacgttaacgttaaccgtggttaggaaccggtaaggttaggtacggttcgggaacccgtaacggttaaaccccgtttggaccgttaacgggacggggtaaccgaacgggtaacccgttcgggtaacccgaaccggttcccg

SEQ ID NO: 333306 - DNA, 680 bp, Homo sapiens
  misc_feature: GZ8MTXP01BBKPE.4.23.C01.1.454.CMB.2.raw
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcagtgaaggtctcctgcaaggcttntggctacacctttaccacctatggtntcaagtgggtgcgacacggccctggacgaaggctgagtggatgggatggatcgagcgacttaacgaagtagggaacaacgaaactatacggacaacgagtaccgttaccgaaggggtacaaggacgtaccaacctacttaacccacgacgaacccacgtaactacccgaacggactaccaacgacggtacccttaacacgtacggaccctagggacggtacgccggtaggacgttagtttacggaaccgtaccgacgggtacctaattaacgttaactttaaccgtggttacggaacgaaggttagggtacggttacgggacccggtaaacgggttaaacccgttggaaccgtaacggtacggggaacccgtaacggggtaccccttacgggtcccgttaacccggttcccg

SEQ ID NO: 333307 - DNA, 589 bp, Homo sapiens
  misc_feature: GZ8MTXP01A9QGA.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgccccactcccaggttcacctggagcagtctggacctgaggtgaagagcctggggcctcagtgaaggtctcctgcaaggcttctggctacacctttaccacctatggtgtcaactgggtgcgacacggcccctaggacgaagggcttggaggtggagtgggatggatcaggcgactttaacaagtcggggaaacacgaaaactatcgacaacaggaccgttaccgaaaggggcaagagtacacacttaccacagacacataccacgagacacacgcctaacagtggacctggaagacggactaggagtattagacgacacggccaatataattacgtgtgcgtaagaggtagttcgggaccggaacggttaacgttggacctaacgggtcgggccgaggggtaccccttagggtccgttaacggttcccg

SEQ ID NO: 333308 - DNA, 670 bp, Homo sapiens
  misc_feature: GZ8MTXP01EI4ZT.4.23.C01.1.454.CMB.2.raw
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (361)..(361): a, c, t, g, unknown or other
  misc_feature (361)..(361): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagagccgtgggcctcagtgaaggtctcctgcaaggcttcnggctacacctttacaccttatggtntcaacgtgggtgcgacacggcccctaggacgaagggcttggaggtgagtggatcggatcgagcgtactttaacgaagtggaaacacaaactntcgacacgagtaccgttaccgaagggaccaaggacgtaccaaccctaattaacccgaacacgaaccacactaccgaacgacgacaactaacggccctaaacacgtacgacgtaggaacgtacgacggtagtaagtacgttacgaaccgacgacgtactaagtacgttagttcgtacgtggtaacggacggttaaggtaggttacgggttaaccggggaacccggttaaaccggttaaaccgttacggtaaccggtacgggtaaccggggaccggtaaccgggttacccgttcggttaaccccgtaaccg

SEQ ID NO: 333309 - DNA, 669 bp, Homo sapiens
  misc_feature: GZ8MTXP01BYVPW.4.23.C01.1.454.CMB.2.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
tcagagcactgtagcacgaccggtgctcgatttagtacacgtgattagggattggggacccaaaaaccacaccctccttgggcgaatccctagatcacagctcctcaccatggactggacctggagcattccttttcttggtggcagcagcaacaggtgcccactcccaggttcacctggagcagtctggacctggaggtgaagagccgtggggcctnagtgaggtctctgcaggcttcnggctacactttaccactatggtntcaacgtggtgcgacacggccctggacgaggcttgagtggagtggatggatcgaggcgtacttaacgaagtaggggaaacaacgaaactagtaccgacaacgaaggtaccgttaccgaaaggggaccaaggacgtaccaaaccctaacttaacccgaacgaacgaacacactaccgaacgacgaccaacgaacgaccttaacgagttacggaccgtaggaacggacgaccggtaggtaacggtaacgtttacggaacgtaaccgacggtacctaaagttagttaacgtttacgtagttcggaacggtagagggtacgttacggggaccgtaaacgggttaaaccttggaaccgttaagggacgggaaccgacgggtaacccgttggtaacccgttaacggttcccg

SEQ ID NO: 333310 - DNA, 648 bp, Homo sapiens
  misc_feature: GZ8MTXP01EEJD6.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagagccgtgggcctcagtgaaggttctcctgcaaggtcttctggctactacctttaccacctatggtgtcgaacgtgggtgcgacacggcccctaggaacgaagggtctttggaggtggagtgggagtggatcgagcgtctttaacgaagtagggaaaccaacaaaacttagtacgacacgaagtacgttcccgaaagggctaagtagtaccaacctaacttaacccacgaacgaccaacactaccgaacgacgaccaacgaacgtaccttacacgtacggaaccctggacggtacgaccgtaggacgttagttacgacgacgaccggactaatatattacgtgtgcggaagagtacgttacgggaccggtaacggttaaaccgttcgaacgtcggtaggggcccgtaacgggtaacccgttcggtaaccgttaaccggttccg

SEQ ID NO: 333311 - DNA, 691 bp, Homo sapiens
  misc_feature: GZ8MTXP01CHWZW.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggactgaggtgaagagccgtgggctgagtgaaggtctctgcaaggcttctggctactacctttaccactagtggtcgtacaacgtgggtgcgacgacggccctaggacgaagggcttggagtggagtgggatggatcgagcgtacttaacgaaagtcgggaaacaacgaaaactagtcggacaacgtaacgtaccggttaccgaaaggggactaagttacggtacccaaacctaacttaacccaacaacgaacacaactaccgaacgacgaccaacacgacctaacacgtacggaccgtaggaacgggacgaccgtaggtaacgtacgtttacggaaccgacgaacggtacctaaattaacgtaacttacgtggtagaacggaagttacgggtacggttacggggaacccggtaacggttaaaccgtttcggaaccgttaacgggtacggggaaccgtaacggggtaacccgttcgggtaacccgttaacccggttcccg

SEQ ID NO: 333312 - DNA, 582 bp, Homo sapiens
  misc_feature: GZ8MTXP01B0YIW.4.23.C01.1.454.CMB.2.raw
  modified_base (268)..(268): a, c, t, g, unknown or other
  misc_feature (268)..(268): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaactgggtgcgacaggcccctggacaagggcttgagtggatggggatggatcgagcgctttacgaagtggaacacaaactatcgcacagacgtccaagggcaagacgtcaccataccacagacacatccacgagcacacgctacatcggacctggacggcgcgtgaagtattcggacgaccgacggccaattatacgttactgtgcggagaggtagttacggggaccgaacgggttaaacccgttggaaccgttaacggtacgggggaacccgtaacggggacccgttcggggtcccttaacccgggttccc

SEQ ID NO: 333313 - DNA, 669 bp, Homo sapiens
  misc_feature: GZ8MTXP01E08SU.4.23.C01.1.454.CMB.2.raw
  modified_base (275)..(275): a, c, t, g, unknown or other
  misc_feature (275)..(275): n is a, c, g, or t
tcagagcactgtagcacgaccggtgctcgatttagtacacgtgattagagattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctcagtgaagtctctgcaaggcttctggctacacctttaccacctatggtgtcaactgggtncgacacggcccctggacaagggcttgagtggatgggatggatcagcgacttaacagtagggaaacaacaaactagtacgacaacgaggtacgttacccgaagggcaaggacgtcccaacctaacttaaccaacgaacgaaccaacaactaccgaacgaacgcaaccacgaccctaacacttacgggaaccgtaggaacggacgggcccgtaggaagtacgtttacggaaccgaccgaccgggtaccctaataacttacgttaactggttcggacgaggtagttaagggttacggggaacccggaacgggttaaaacccgttgggtaaccgtacgggtaaccgggggaacccggtaacggggttaccccggtaagggttaacccgtaaccccggg

SEQ ID NO: 333314 - DNA, 685 bp, Homo sapiens
  misc_feature: GZ8MTXP01BUEE5.4.23.C01.1.454.CMB.2.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtggggcctnagtgaaggtctcctgcaaggcttntggctactacctttaccaccttatggtctcgaacgtgggtcgacgacgacggcccctaggacgaagggtcttaggagtaggagtgggatggatcgagcgtactttaagaagtagggaaacacgaaacgtatacgacacgacgtaccgttaccggaaagggtaccaagggtaactaccaacctacttaacccacgaacgaacctacaccaccgaacggacaccaacgtaacgaccctaacgtacgtacgggacccgtaggaacgggtaccgtaccggtaaggtacggtacgtttaccggaaacgaccgtaccggtacctaaagttaactaacgttacgtggtacgaacgaagttacgggtacgttcgggaccgtaacggttaacgttcgacgttaacggcgggaaccgacgggtacccgttggtaacccgttcccgtaacccg

SEQ ID NO: 333315 - DNA, 705 bp, Homo sapiens
  misc_feature: GZ8MTXP01BT0TZ.4.23.C01.1.454.CMB.2.raw
  modified_base (283)..(283): a, c, t, g, unknown or other
  misc_feature (283)..(283): n is a, c, g, or t
  modified_base (359)..(359): a, c, t, g, unknown or other
  misc_feature (359)..(359): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcagtgaaggtctcctgcaaggcttctggctacctacctttaccacctatggtgtctaacgtgggtncgacacggcccctggacgagggcttgagtggagtgggatggatcgagcgcttaacgaagtagggaaacacaaactntcgacacgagtaccgttaccgaaggggacaaggtacgtaccaacccgtaacttaacccacaacgaccaaccgaactacccgaacgacgaccaacgaacggtacccttaacgacgtaacggacccgttaggaacgggtaccgtaccggtaggtaaggttaacgtttacggaaccgtaaacccgacccgggtacctaaagttaacgttaacgtttaccgttaggttcggaacgtaaggttacgggtagtttcggggaaacccgggtaacggttaaaccgttcgaaccgtaacgggtcggggaacccgtaacggggtacccgttacgggtcccgttaacccggttcccg

SEQ ID NO: 333316 - DNA, 595 bp, Homo sapiens
  misc_feature: GZ8MTXP01EL2XR.4.23.C01.1.454.CMB.2.raw
  modified_base (444)..(444): a, c, t, g, unknown or other
  misc_feature (444)..(444): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttacacctatggtgtcaacgtggtgcgacacggccccgtggacgaagggcttgaggtggagtggagtggatcgagcgacttaacgaagttaggaacaacaaaactatacgacacaggtaccgttccggaaagggcaaggagtacaccctaacttaaccacacgacacgatacccagacacacacgccctanagcggacctggagacgccgtagagtattcggaccgtacgaccggaccaatattaatacgtgtcggaagagagtacggttggaccgtaacggaacgttgaccgttaagggtccgggaaccgacgggaccgttggtcccgttaaccgtccccg

SEQ ID NO: 333317 - DNA, 544 bp, Homo sapiens
  misc_feature: GZ8MTXP01B2MDW.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaactgggtgcgacaggcccctggacaagggcttgagtggatgggatggatcagcgctttacaagtgggaacacaaactatcgcacagacgttccaagggcaagagtcaccattaccacagacacatccacgagacacagcctacatggacctgaggagccgtgagtatttgacgacaccggcatatattactgtgcgagagacgttgggaccgaacggttaaccgttgaccgttaacgtggggaaccaggggaacccttgggtccaaccggttcc

SEQ ID NO: 333318 - DNA, 648 bp, Homo sapiens
  misc_feature: GZ8MTXP01C1O5A.4.23.C01.1.454.CMB.2.raw
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttctggtggcagcagcaacaggtgcccactcccaggttcacctggagcagtctggacctgaggtgaagagccgtggggcctcagtgaaggtctcctgcaaggcttnggctacacctttaccactatggtntcaacgtgggtgcgacgacggccccgtggacgaaggcttgagtggagtgggatggatcgagcgtactttaacgaagtagggaaacaacgaaatagtacgacacgagtaccgttaccgaaaggggacaaggacgtaccaaacctaactaaccccaacgaacgaccaactaacacccgaacgacgacctaaccgacgacccttaacgacgtacggaaccgtaggaacggtacgaccggtaggtaagttaatttacggaaccgtaaccgaccggtactaaagtattagttacgtggtagcgtagagtacgttcgggaccgtaacgttaaacgttgaacgttaacggacgggaaccgacgggaccgttcggtaaccgttccgtcccg

SEQ ID NO: 333319 - DNA, 709 bp, Homo sapiens
  misc_feature: GZ8MTXP01DKG3G.4.23.C01.1.454.CMB.2.raw
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtcgcccactcccaggttcacctggagcagtctggacctgaggtgaagagccgtgggctnagtgagtctctgacagtcttcgtgctactaccttacactatggtntcaacgtggtgcgacgacggcccctaggacgaagggtcttggaggtggagtgggatggatcgagtccgtacgtttaacgaaggtaggaaacaacgtaaactagtaccgaccaacgaaggtacccgttccggaaagggacaaggtaccgtaaccaaacccgtaacttaaccccaacgaacgaaacccacaacgtacccgaaacgacgaccaacgaaccgtacccgttaacacggtacggaacccgtagggaacggtaccgtaccggggtagtaacggttagttaccggaaccgtaaacccgcggtaacctaagttacttaacgttacgtaggtcggtaacgaagagggttacgttaccggggaaccggtaacggttaacgttcggaaccgttcgggtaccgggaaccgtaacgggaccccgttgggtaaccccgttaacgttcccg

SEQ ID NO: 333320 - DNA, 577 bp, Homo sapiens
  misc_feature: GZ8MTXP01AUC68.4.23.C01.1.454.CMB.2.raw
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (428)..(428): a, c, t, g, unknown or other
  misc_feature (428)..(428): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctnagtgaaggtctcctgcaaggcttctggctacacctttaccaccttatggtntcaacgtgggtgcgacacggcccctggacaaggcttgagtggatgggatggatcgagcgactttacgaagtgggaaacacgaaactatcggacacgagtaccgttccgaagggcaaggacgtacaccataccacagacacatccacgagcacacgcctanagtcggacctggacggagccggtagaagtatttcgaacgacgaccggacaatatatacgtgtgaacgagagtagttcggggaccgaacggttaaccgttgaccgtcggtagggggccaacggggtacccttcggtccgaaccggttccc

SEQ ID NO: 333321 - DNA, 660 bp, Homo sapiens
  misc_feature: GZ8MTXP01A563C.4.23.C01.1.454.CMB.2.raw
  modified_base (372)..(372): a, c, t, g, unknown or other
  misc_feature (372)..(372): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctggaggtgaagagccgtggggcctcagtgaaggtctcctgcaaggcttctggctactaccttaccacctatggtgtcaacgtgggtcgcgacgacggcccctgggacgaagggcttggaggtggagtggggatgggatcgaggtcgactttaacgaagtacgggaaacaacaaacgtntacgacacgacggtaccgttccgaaagggactaagtacgtacaaccgtaattaccaacacgacacactaccacgacgaccaacgaacgacccttaacgacgtacggacccgtaggaacggacgtccgtagggtaagttacgttacggaaaccgacgaccggtacctaagttacttaacgttacgtacggtgaacggtaagttaggtacggttacgggaccggtaaacgttaaccgttgacgtaacggcggggaaccgaacgggtaccgttcggtccgttaacccgtcc

SEQ ID NO: 333322 - DNA, 702 bp, Homo sapiens
  misc_feature: GZ8MTXP01AV1PP.4.23.C01.1.454.CMB.2.raw
  modified_base (268)..(268): a, c, t, g, unknown or other
  misc_feature (268)..(268): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaacgtgggtgcgacaggcccctggacaagggcttggagtggagtgggatggatcgagcgtactttaacgaagtagggaaacaacgtaaactagtaccggacaacgaacggtacccgttaccgaaagggggcaaggtacgtacccaacctaacttaccaacgaagaaacccacaactaccaacggacacaacacgacctacagtacggtaccgaggaggacgccgtagtaagtacgtttacggaaccgaccgaaccggacctaattaattacgtttaaccgtggttggtaacggtaagggaaggtaacgggttaccgggggtaacccgggtaaaccgggttaaacccgttggttaaccggttaaccggggtacgggggaacccgtaacgggggtaaccccgttcggggtaacccgttaacccgggtttccccg

SEQ ID NO: 333323 - DNA, 649 bp, Homo sapiens
  misc_feature: GZ8MTXP01D88L4.4.23.C01.1.454.CMB.2.raw
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcagtgaaggtctcctgcaaggcttcnggctactacctttaccaccttatggtntacagtggtgcgacgacggcccctaggaccgaagggtcttgaggtggagtgggatggatcgagtcgtactttaacgaagtagggaaacaactaaactatacggcaacgaaggtacccgttaccgaaacgggacaaggacgtaccaaaccctacttaacccgaacgacgaacaaccactacccgaacggacaccacgacgaccctagacgtacggacctaggaacggacgtaccggtagacgttacgttacggaaccgaaccgaacggcctaattataattcgtagtcgaagagagtacgttacgggaccgtaacgttaaccgttgaccgttaaggcgggtaacgaaccgggtaccgttcggtaaccttccggttaaccc

SEQ ID NO: 333324 - DNA, 660 bp, Homo sapiens
  misc_feature: GZ8MTXP01CBFL0.4.23.C01.1.454.CMB.2.raw
  modified_base (215)..(215): a, c, t, g, unknown or other
  misc_feature (215)..(215): n is a, c, g, or t
  modified_base (459)..(459): a, c, t, g, unknown or other
  misc_feature (459)..(459): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggactgaggtgaagagctgggctnagtgagtctctgcaggcttctggctacacttacactatgtgtcacgtggtgcgacacggcccctaggacgaagggtcttggagtggagtgggatggatcgagtcgactttaacgaagtacgggaaacaacgaaactagtacgacacgaagtaccgttaccgaaaggggtacaaggaacgtaccaacctaacttaaacccaacaacgaaccaacactacccaacgacgactaacgacgaccctanacgtacggaccgtagacggacgaccgtaggaagttacgtttacggaacgaacgtaccggactaaagttacttaaacttacgtgttaggaacgtaaggaggtacggttcggggaaccgtaacggttaaaccgtttggaaccgttaacgggtacggggaacccgtaacggggtacccgttcggtaacccgttaaccgttcccg

SEQ ID NO: 333325 - DNA, 694 bp, Homo sapiens
  misc_feature: GZ8MTXP01DJYDB.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagagccgtggggcctcagtgaaggtctcctgcaaggtcttctggctacacctttaccactatggtgtcaacgtgggtgcgacgacggcccctaggacgaaggcttgagtggagtggagtggatcgagcgtacttaacgaagtggaaacaacaaactatcgacacgagacgtcgaagggcaagacgtacaacataccacagacacactaccacgagacacacgacctaacacgtcggaccgtaggaacggacgaccggttaggtaacggttaacgtttacgggaaccgaaccgaaccggtaccctaaatttaaacttaacgtttaacgttaggtacggtaacggaaaggttacgggtaaacgggtttacgggggaaaccccggtaaacgggttaaaacccgtttcggttaacccggttaaccgggtacgggggtaaccccggtaaacgggggtaccccgttacgggtaaccccgttaaccccggtttcccg

SEQ ID NO: 333326 - DNA, 637 bp, Homo sapiens
  misc_feature: GZ8MTXP01BQPOC.4.23.C01.1.454.CMB.2.raw
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (471)..(471): a, c, t, g, unknown or other
  misc_feature (471)..(471): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagagccgtggggcctcagtgaaggtctcctgcaaggtcttntggctactacctttaccactatggtntcaacgtggtgcgacacggcccctaggacgaagggtcttggagtggagtgggatggatcgagcgtacttaacgaagtacggaaacaacaaactatacgaccaacgacgtaccgttccgaaagggacctaagtacgtacccaaaccctacttaaacccgaacgaacgaacctacactaccaacgacgacaacacgacctanacgtacggaccgtggaaggacgccgtaaggagttaacgttcggaaccgtaaccgacggactaataatattacgtgtgaacgagaggtacgttacgggaccgtaacggttaacgttggaccgtaacgggtcgggaaccgtacgggacccgttggtaaccaacgtccg

SEQ ID NO: 333327 - DNA, 636 bp, Homo sapiens
  misc_feature: GZ8MTXP01AF0UU.4.23.C01.1.454.CMB.2.raw
  modified_base (266)..(266): a, c, t, g, unknown or other
  misc_feature (266)..(266): n is a, c, g, or t
  modified_base (330)..(330): a, c, t, g, unknown or other
  misc_feature (330)..(330): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttctggtggcagcagcaacaggtgcccactcccaggttcacctggagcagtctggacctgaggtgaagagcctggggcctcagtgaaggtctcctgcaaggcttctggctacacctttaccacctatggtntcactgggtgcgacaggcccctggacaagggcttggagtggatgggatggatcaggcgcttaanaagtcgggaaacacaaactagtcgacactaggaccgttccgaaggggaccaaggtacggtaccaaccctaactttaacccacgaacgaacacactacccaacgacgaccaacgacgtaccctaacgacgtacgggaaccctaggacgggaacggacccggtagaacggtattacggaacgacgacgactactagtacttacgnggtncggaagagtaggttcggacccggtaacggttaaccttcggacgtaaccggtcgggaacccgaacgggtaaccccgttggtaacccgttaacgttccccg

SEQ ID NO: 333328 - DNA, 697 bp, Homo sapiens
  misc_feature: GZ8MTXP01EKKE8.4.23.C01.1.454.CMB.2.raw
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagcctggggcctcagtgaaggtctcctgcaaggcttctgctacacctttacactanggtntcacgtgggtncgacacggccctaggacaagggcttgaggtggagtgggatggatcgaggcgctttaacgaagtagggaaacaaacgaaactatcgacaacgagtaccgttaccgaaaggggcaaggacgtacaacccaaacttaacccaacgacgaaccaacaactacccaaggacaccaacaacgcctaacaacgtacggaaccgtggaagggacgaccggttaggaaggttaacgtttacgggaaccgacgaaccgggacctaaagttaacttaagtttaaccgtcggttggaaggtaaggaaggtaacggttcgggggaacccggtaaacgggttaaaaccgtttcgggaacccttaacgggggtacgggggtcccgaaaccgggggtaaccccgttagggggtaaccccgttaacccggttccccg

SEQ ID NO: 333329 - DNA, 738 bp, Homo sapiens
  misc_feature: GZ8MTXP01BBDXT.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagccgtggggcctcgagtgaaggtctcctgcaaggtcttcgtggactacctacctttaccaccttagtggtgtacaacgtgggtcgccgaacgacggtccccgtagggaaccgaggggtcttaggaggtggagtggggagtggatcgagtcgtacgtttaacgaaggttacgggaaaccaactaaaacgtactacggacctaaacgacggtaaccggttccggaaagggaccaagtacggtacccaaacccgtaacttaacccgaaacaacggaaaccacctaacgtacccgaacgacgaccaacgaacgacctaacagtaccggaccgtaggacggacgtccgttaaggaggtaacgttacgaacggtaaccgaccggtactaactaattaacgttacgtacggtggaacggtaaggttagggtacggttaccggggaccggtaaacggttaaccggttcgttacggttaaccgggcggggtaaccggaaccggggtacccgttcgggtaacccgttaacccggtttcccg

SEQ ID NO: 333330 - DNA, 626 bp, Homo sapiens
  misc_feature: GZ8MTXP01BGZN4.4.23.C01.1.454.CMB.2.raw
  modified_base (425)..(425): a, c, t, g, unknown or other
  misc_feature (425)..(425): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctaccacctttaccaccttatggtgtcaacgtgggtgcgacacggcccctggacgaaggcgttgaggtggagtgggatggatcgacgtcgactttaacgaagttacggggaaacaacaaactatacggacaacaggtaccgttcccgaaaggggcaaggacgtaccaaccacttacccanaacgaacacatacccaacgagaccaacgaacgcctaacacgtacggaccctaggacggacgccggtaggaagtacgtttagaaccgaccgaccggacctaatattaacttacgtgtgaacggtagaggtagttcgggacgtaacggttaacgttcgacgtaacgtcggggaaccgagggacccgttggtccgaacgtcccg

SEQ ID NO: 333331 - DNA, 630 bp, Homo sapiens
  misc_feature: GZ8MTXP01AVT7C.4.23.C01.1.454.CMB.2.raw
  modified_base (379)..(379): a, c, t, g, unknown or other
  misc_feature (379)..(379): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctactacctttaccacctatggtgtcaacgtgggtgcgacaggcccctggacagggcttgagtggatgggatggatcgagcgctttacaagtagggaacacgaaactatcgacacgagacgttccgaagggacnggacgtcgaccacttaccaacacgacacataccacgacgcaacacgacctacacgtacggacctaggaggacgaccggtaggaagtacgttggaaaccgacgaccggacctaattaacttacgttaccgtgttggaacggtaagaggtacggttcggggaccgtaacgggttaaacccgttgaacccgtaacggttcgggggaacccgttacgggggaaccccgttgggtaacccgttaacccgggttccc

SEQ ID NO: 333332 - DNA, 634 bp, Homo sapiens
  misc_feature: GZ8MTXP01EHLTS.4.23.C01.1.454.CMB.2.raw
  modified_base (266)..(266): a, c, t, g, unknown or other
  misc_feature (266)..(266): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctcagtgaaggtctcctgcaaggcttctggctacacctttaccacctatggtntcaacgtggtgcgacacggccctggacgagggctgagtggagtgggatggatcgagtcgactttaacaagtagggaaacaacaaaactatccggacaacgacggaccgttccggaaacggggcaaggtacgttaccaaaccctactttaaaccccaacgaacgaaccactaactacccaacgacgaccaacgaacgacctaacagtacggacctaggacggacgccggtaggacgtagtttacgaccgaacgacggtactataacgtattaacgtgtcgaagtaggagtacggttacgggaccgtaacggttaacccgttgacgtaacggtgggaaccgtacgggacccttcggtaaccgccgttccg

SEQ ID NO: 333333 - DNA, 674 bp, Homo sapiens
  misc_feature: GZ8MTXP01EREVZ.4.23.C01.1.454.CMB.2.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagagccgtgggcctnagtgagtctctgcagcttngctactacttacactatggtntcaacgtgggtgcgacgacggccctaggacgagggtcttggagtgggagtgggatggactcgagcgtactttaagaagtagggaaacaactaaaactagtacgactaacgagtaaccgttcccgaaagggtaccaaggtacgtacccaacctaacttaacccgaacaacgaaccactacaccgaacgacgacaacgaacgacctaacgagtacggacctaggacggtacgacgggtaggtaagtattacggaaccgaacgaccggactaatactaacgttacgtgtaggaacgtaaggttacggtacggtttaccggggaaccgtaaccggttaaacgttcggttaaccgttaacgggtaccgggggtaaccgtaaccgggggtacccgttacgggtccttaacccggtttcccg

SEQ ID NO: 333334 - DNA, 663 bp, Homo sapiens
  misc_feature: GZ8MTXP01C4F7H.4.23.C01.1.454.CMB.2.raw
tcagagcactgtagcacgaccggtgctcgatttagtacacgtgattagggattggggacccaaaaaccacaccctccttgggcgaatcccctagatcacagctcctcaccatggactggacctggagcattcctttttcttggtggcagcagcaacaggtgcccactcccaggttcacctggagcagtctggacctgaggtgaagagccgtgggcctcagtgaaggtctcctgcaaggtcttcgtggcttacacctttaccaccttatggtgtcaacgtgggtgcgacgacggcccctaggaccaaggggcttggagtggagtgggatggatcaggcgtactttaacgaagttagggaaacaacgaaaacttatccggacaacgaaggaaccgtttacccgaaaggggacaaggtaacgttaccaaaccctaagttaccccaacgtaacgaacccaaccaactacccgaaccggaagacctaaacgaacggtaccctaacgacgttacggacccgtaggaacgggacgtccgtaggaagtagtttacggaacgaccgaacggtccaattatacttagtgtggaacgtgagtagttcgggtaacgacggttaaacgttgaccgttggacgggcgtacgggaccgttgggtaaccaacggttccc

SEQ ID NO: 333335 - DNA, 656 bp, Homo sapiens
  misc_feature: GZ8MTXP01EKV6I.4.23.C01.1.454.CMB.2.raw
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctctgcaaggcttcnggctactacctttaccacctagtggtntcaacgtgggtgccgacgacggcccctaggacgaagggtcttggagtggagtgggatggatcgagcgtacttaacgaagtcggaaacacaaactatcgactaacgagtaccgttaccgaaacggggacaaggtactaccaacctaacttaacccaacgaacgaacaacgtacaccgaacgacgacactaacgcctaacacgtacggacctaggaacggacgccgtaggtaaggtacgtttacgaaccgaacgaaccggacctaaagtaattacgttactcgtgaagtaaggaggtacgttacgggaccgtaacggttaaaccgttcggaacgttaacgggacgggtaaccggacgggtaacccgttcggtaacccgttccgtcccg

SEQ ID NO: 333336 - DNA, 844 bp, Homo sapiens
  misc_feature: GZ8MTXP01D4P5N.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtgggcctcagtgaaggtctcctgcaaggcttctggctacacctttaccacctatggtcgtcaacgtgggtgcgacgacggcccccgtaggacgaaagggtcttaggaggtgggagtggggattgggatcgacggtcggtactttaacgaaagttacgggggaaaaccaacgtaaaaacgtacgttaccggaacctaacgaaacgggtaacccggtttacccgaaacgggggtaccaacgggtaacgtttaacccgaaaccccgtaactttaaaccccgaacgtaaacggaaaccaacctaaccttaaccccgaacggaacggaaccaaccgaaccggacccttaaccgaagttaccgggaaccgttacgggaacggggtaaccggtcccggggttaaggtaacggttaaacgtttacgggaaaccggtaaacccgaccggggtacccctaaaatttaagttaacgtttaaaccgtgggttaacggaaccgggtaaaggttagggttaaacgggtttacgggggacccgggttaaacggttaaaacccggtttcgggaacccggttaacgggtaccgggggaacccgtaacgggggtaccccgttacgggtaacccgttaacccgggtttccccg

SEQ ID NO: 333337 - DNA, 698 bp, Homo sapiens
  misc_feature: GZ8MTXP01DBHJF.4.23.C01.1.454.CMB.2.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtgggcctcagtgagtctctgcagcttngctacacttacnctangtntcacgtggtgcgacgacggcccgtaggacgagggtcttaggagtggagtgggtatgggtatcgaggtcgtactttaacgaagtacgggaaacaacgtaaactgtaccgaccaacgacggtaccgttaccgaaagggacaaggtacgtacccaaaccgtactaaccaagaacgacaaccactacccacgacgaccaacgacgaccctaacgacgtcggaaccgtaggaacggtacgtaccggttaggtaacgttacgtttacggaaccgtaaccgaccggtactaacgttaaattacgtttaacgtgtggtaacgtaaaggttacgggttaacggttaccggggaacccggtaaacgggttaaacccgttcggttaaccggttaaccgggacggggaaccggtaaccggggtaccccgttggtaacccgttaacccgttcccg

SEQ ID NO: 333338 - DNA, 709 bp, Homo sapiens
  misc_feature: GZ8MTXP01CWJW2.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatcctttttcttggtggcagcagcaacaggtgcccactcccaggttcacctggagcagtctggacctgaggtgaagagccgtggggcctcagtgaaggtctcctgcaaggtcttctggctaccacctttaccaccttatggtgtcaacgtgggtcgcgacacggccccgtggacgaaggcttggagtggagtggatggatcgagcgtactttaacgaagtagggaaaccaacaaactagtacgaccaacgacggtaacccggttaccgaaaggggtaccaagggtaaccgtacccaacccgtaacttaacccgaacaacgaaaccaaccaactacccgaacggacgaccaacgaacgtaccctaacgtaacgtcggaacccgtagggaacggacgaccggttaggaacgttacgtttacggaaccgtaaccgaccggtacctaaagttacttaaacgttacgtggtagaacggtaaggttaggtacggttacggggaaccggtacggttaaaccgttcgttaccgtaacgggtacgggaaccgtaacgggacccgttcggtaacccgttaaccgttcccg

SEQ ID NO: 333339 - DNA, 586 bp, Homo sapiens
  misc_feature: GZ8MTXP01D1IZN.4.23.C01.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtgggcctnagtgagtctctgcagcttngctacacttacactatgtntcacgtggtncgacacggccctggacgaaggcttgagtggagtgggatggatcgagcgtactttaacgaagtaggaaaccaacaaactatcgacacgaaggtaccgttaccgaaggggaccaaggacgtaccaacctaacttacccgaacgacgaaccacactaccacggacacacacgacctacagtacggacctggaacggcgacggtgagtattcgaacgacgacgacatatatacgtgngtgagngtagttcgggaccgtaacggaaccgttgaccgtaacggtacggggccgtaacgggacccgttacggtccgttccgttcccg

SEQ ID NO: 333340 - DNA, 688 bp, Homo sapiens
  misc_feature: GZ8MTXP01DCD6H.4.23.C01.1.454.CMB.2.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtcgcccactcccaggttcacctggagcagtctggacctgaggtgaagagcgtgggctgagtgagtctctgcagcttcngctactaccttacactatggtntcacgtggtgcgacgcggcccaggacgaaggctagaggtggagtggagtggatcgagcgtactttaacgaagtacggaaacaactaaactataccggactaacgacgtacgttaccgaaagggcaacggtacgtacccaaacctacttaacccagaacgaaccaacaacgtacccgaaacggacaccaacgaaccgacctaacgagtacggaccaggacgacaccggggtagtaacggttacgttacggaacgaacccgtaacggacccttaaatagtttaacgttacgtaggttacgaacggaggttaacggttaggttaccggggtaaaccggtaacgttaaaccggttcgttaaccgggttaaccgggtacgggaacccggtaacggggtacccgttacgggtaacccgttaacccggttccccg

SEQ ID NO: 333341 - DNA, 653 bp, Homo sapiens
  misc_feature: GZ8MTXP01EQHTU.4.23.C01.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
tcagagcactgtagcacgaccggtgctcgattttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagagccgtggggcctnagtgaggtctcctgcaaggcttntgctactacctttaccacctatggtgtcaacgtggncgacgacggcccctggacgaagggtcttggagtggagtgggatggatcgagcgtacttaacaagtaggaaacaacaaaacgtatacgacaacgagtaccgttaccgaaagggacaagtacgtacaacccgtactaacccaacacgaccaacgactaccaacgagactacacgacctaacagtacggaaccgtggacggggactccgggtaggtaagttacgttacgaaccgtacgacccggtactaaagttattacttacgtggtgaacggaggttaagcggttacgggacccggtaacgaaaaccgtttggaacccggttaacggccgggggaaccaccgggggtaaccttcggtaaccgttaacccgtccg

SEQ ID NO: 333342 - DNA, 671 bp, Homo sapiens
  misc_feature: GZ8MTXP01EWHSN.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctactacctttaccacctatggtgtcaacgtgggtgcgacacggcccctaggacgaagggcttggaggtggagtgggatggatcgaggcgtactttaacgaagtagggaaacaacaaaactatcgactacgaagtaccgttaccgaaggggacaaggtacgtaccaacctaacttaacccaacgaacgaaccacactacccaacgacgaccaacgacgacctacagtacggacctaggaacgacgccgtaggaacgtacgtttacggaaccgacgaccgggacctaagttacttaacttaccgtaggtcggaacggtaaggaagtacggttacggggaccgtaacgggaaacccgtttcgaaccgttaacggtacgggggaacccgaacgggtaccccgttcgggtaacccgaacccgggttcccg

SEQ ID NO: 333343 - DNA, 652 bp, Homo sapiens
  misc_feature: GZ8MTXP01AK0GW.4.23.C01.1.454.CMB.2.raw
  modified_base (358)..(358): a, c, t, g, unknown or other
  misc_feature (358)..(358): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcgagtgaaggtctcctgcaaggcttcgtggctactaccttaccacctatggtgtcacgtggtgcgacgacggccccgtaggacgagggtcttggagtggagtgggatggatcgacgcgtacttaacgagtaggaaaccaanaaactagtaccgacaacgtacggtaccgttccgaaacgggtaccaaggtacgtacccgacctaacttaacccgactaacgaaccacactacccacgacgaccaacgacgtccttaacgacgttacggacctagggacggacgaccgtagggtaacgttacgtttacggaaccgaaccgtacggacctaagttacttacgttaccgtgcggtaagagttaggtagttccgggacgtaacgttacgttgaccgttaacgggcggtccgaccggtcgttcgtccgttccgtaacccg

SEQ ID NO: 333344 - DNA, 596 bp, Homo sapiens
  misc_feature: GZ8MTXP01ECGZ5.4.23.C01.1.454.CMB.2.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (510)..(510): a, c, t, g, unknown or other
  misc_feature (510)..(510): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggacctgaggtgaagagcctgggcctnagtgagtctctgcaggcttngctactaccttaccactatggtntacaacgtgggtncgacgacggccccgtaggaccgaagggtcttggagttggagtgggatgggatcgagtcgtactttaacgaagtaggaaacaactaaatctcgacctaacgagtaccgttcgaacgggacaaggactaccaacctaactaccgacagaccacanccaagagacactacgacctanacgngaccngaaggcgacgtagacgtattacgacgacgaccgactaattactattactggtnaacgagagtggttcggaccgtaacggttacgttgaacgttaacgggacgggtccgaacgggtaccgcggtaaccaacccggttccc

SEQ ID NO: 333345 - DNA, 683 bp, Homo sapiens
  misc_feature: GZ8MTXP01EBTI9.4.23.C01.1.454.CMB.2.raw
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (324)..(324): a, c, t, g, unknown or other
  misc_feature (324)..(324): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaggtctctgcaggcttngctacaccttacactatggtntcaatgggtncgacncggcccctggacaagggctgnggtggagtgggatggatcgagcgcttaanagtaggaacacgaaactatacgcaacgacggtacgttccgaaagggtcaagtacggtaccaacccgtaattacccaagacgtaaccacacttaccacgacgacaacacgaccttaacgacgtacggaccgtaggaacgggtacgtacccgggtaggtaagttaacgtttacgaaccgtaaccgaccgggtacctaaagttaacgttaacgtttaccgtaggttcggaacggtaaggttaacggtaacggtttacggggaccccggtaaacgggttaaaccgtttcggttaaccggttaaccgggtacggggtaacccggtaacgggtacccggttacggttaaccgaacccgtttcccg

SEQ ID NO: 333346 - DNA, 811 bp, Homo sapiens
  misc_feature: GZ8MTXP01AXMIW.4.23.C01.1.454.CMB.2.raw
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
  modified_base (376)..(376): a, c, t, g, unknown or other
  misc_feature (376)..(376): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctggaggtgaagagcctgggcctgagtgaaggtctcctgcaaggcttcnggctactacctttaccaccttatggtntcaacgtgggtgcgacgacggcccctaggacgaagggcttggaggtggagtgggatggatcgagtcggtactttaacgaagtagggaaaccaacgtaaaaccgttanaccggaccaaacgtaacggtaacccggtttacccggaaacgggggtaccgaacgggtaaaccggtacccaaaccccgttaaacgtttaaacccccaacgggtaaacgtaaaccccaaaccgttaaacctaacccccgaaacgggaccgaaacccttaaccgaaacccgttaccccgttaaacgaaccggtttacgggaaccccgttgggaacgggtaaccgtcccgtaaggggtaacgtttaaccgttacgggaaaccgtaccgaccggaccttaagttaacttaacgtttacgtaccgggtagccgggaaaggttaggtacggttccgggggaaacccgtaaacgggaaacccgtttggaacccggttaacggggtaccggggaacccgtaacggggtaccccgttacgggttaaccccgaaccggtttccccg

SEQ ID NO: 333347 - DNA, 678 bp, Homo sapiens
  misc_feature: GZ8MTXP01CGWQA.4.23.C01.1.454.CMB.2.raw
  modified_base (241)..(241): a, c, t, g, unknown or other
  misc_feature (241)..(241): n is a, c, g, or t
  modified_base (359)..(359): a, c, t, g, unknown or other
  misc_feature (359)..(359): n is a, c, g, or t
tcagagcactgtagcacgaccggtgctcgatttagtacacgtgattagggattgggggacccaaaaaaccacacccctccttgggcgaatcccctagataacagctcctcaccatggactggacctggagcattccttttcttggtggcagcagcaacaggtgcccactcccaggttcacctggagcagtctggacctgaggtgaagagcgtggggctcagtgaaggtctctgcagtcttngctactaccttacactatgtgtcaacgtgggtgcgacacggccctaggacgagggctggagtggagtggggatggatacgagcgtacttaacgaaaggtcgggaaacaactaaaagtntacgaccaacgtagtacgttaccgagggaacacgcgtacaaactacttaccaacgacgaacactacaccgaacgagactaaccagaccctaactcggacggaccgtagggaacggtacgtacccgtaggggtaagtacggtttacgaaaccggtacgtaacgacctaattaacttagtttaacgtggtacgacggaaggtcgttaacgggtttccggggaaccgtaaacgggttaaccttacgggttaaccgttacgggtcggggaacccgggtaacgggtaacccggttcggttaaccgtcccggttaacccttcccg

SEQ ID NO: 333348 - DNA, 617 bp, Homo sapiens
  misc_feature: GZ8MTXP01BIJUH.4.23.C01.1.454.CMB.2.raw
  modified_base (216)..(216): a, c, t, g, unknown or other
  misc_feature (216)..(216): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (443)..(443): a, c, t, g, unknown or other
  misc_feature (443)..(443): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctnagtgaaggtctcctgcaaggcttctggctacacctttacaccttatggtgtcaacgtgggtgcgacaggcccctagacgaggtctgagtggagtggatggatacgngcgtactaacgagtaggaacaacaaatntcgacagagtacctcgaaagggacaaggactacaacctacttaccaacgagaaccacactacccgaagacgaccaacgaaccgtacccttaanacgtacggaaccgaggaacgggacgaccggtaagtaggtaactttacggaacgaaccgaccggactaaagttaatactacgtgtgaacgtaggaggtgttcgggacgtaaccgttacgttgacgtaacggtcggggaaccaacggggtaccacggtaaccgttaaccgttcccg

SEQ ID NO: 333349 - DNA, 828 bp, Homo sapiens
  misc_feature: GZ8MTXP01AWWQ0.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctactacctttaccacctatggtgtcaacgtgggtgccgacacggcccctggacaagggtcttgagtggatgggattcgggatcgagcgtactttaacgaagttacgggggaaaccaacgtaaaacgtgttacccgacgaaccgtaagggtacccgttacccggaaagggggccaacggacgggttacccgaaacccaactttaacccacgaaacggaacccaacggtaactaccccgaaccggaacggacctaaacgaaccggtacccttaaaccgaacgttaccggggaaccccttaggggtaaacgggtaaccggccccggtttaacggaaaggtttaaccggttttaacgggaaacccggtaacccgaaacccggggttaccccgaaagtttaaacgttaccttttaaacccgtgggttaccgggaaccggttaagggaaacggtacggtttaccgggggaaaccccggtaaacgggttaaaccccgtttcggttaacccggtaaccggggttaccgggggtaaccccgaaacggggggtaccccttaccggggttaacccgaaccccgggtttccccg

SEQ ID NO: 333350 - DNA, 691 bp, Homo sapiens
  misc_feature: GZ8MTXP01A4SYA.4.23.C01.1.454.CMB.2.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (432)..(432): a, c, t, g, unknown or other
  misc_feature (432)..(432): n is a, c, g, or t
tcagagcactgtagcacgaccggtgctcgattttagtacacgtgattagggattggggacccaaaaaccacacccctccttgggcgaatcccctagatcacagctcctcaccatggactggacctggagcattcctttttcttggtggcagcagcaacaggtcgcccactcccaggttccaccgtggagcagttctggacctgaggtgaagagccgtgggcctnagtgagtctccgtgacaggtcttcgtgactactacctttacaccttagtggtntacacgtgggtcgcgacgacggccctaggacgtaggtcttggaggtggaggtggatggactcgagtcgtactttaacgaaggtacggaaactaanaaacgttnaccgacacgagtaccgtaccgaaggcaagacgtaccaacctaactaaccaanacgaaccacgtacaccgacgacgacctaacgaccgtacctaacgacgttaacggaccgaggaacggaaccgtcggtaggtaacgttaacgttacgaaccgtaacgaccgtacctaagttaaacgtacgttaacgtgtcggtaacgtaaggagttaccgggacggtaacccggtaacggttaaacccgttggaccggttaaccggggcgggtaaccggttaacccgggaccccgttacggttcccgttcccgttaacccg

SEQ ID NO: 333351 - DNA, 566 bp, Homo sapiens
  misc_feature: GZ8MTXP01CNC00.4.23.C01.1.454.CMB.2.raw
  modified_base (214)..(214): a, c, t, g, unknown or other
  misc_feature (214)..(214): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (557)..(557): a, c, t, g, unknown or other
  misc_feature (557)..(557): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggagcagtctggactgagtgaagagctgggctnagtgaaggtctctgcaaggcttctggctacacctttaccactatggtgtcaacgtgggtgcgacgacggccctaggacgaagggctggaggtggagtgggatggatcaggtcgtactttaacgaagtacgggaaacaacaaacgtatacgacacgacgtacgtaccgaagggcaagacgtacaacactacacganacacanacgagacgacacagcctanagtacgacngaacggagcgtagacgtagtagacgacgacgactagtatatactgtgcgaagagtagttcggaccgtaaggttaaccgttgacgtaaggcgggccgtaacggaccgttggtccnccggtaacc

SEQ ID NO: 333352 - DNA, 685 bp, Homo sapiens
  misc_feature: GZ8MTXP01B5K1S.4.23.C01.1.454.CMB.2.raw
  modified_base (292)..(292): a, c, t, g, unknown or other
  misc_feature (292)..(292): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagccgtgggcctcagtgaaggtctcctgcaaggtcttcgtggctacctacctttaccaccttagtggtgtcaacgtgggtgcgacncggccctggacgaagggtctggagtggagtgggagtggactcgagcgtactaacgaagtaggaaacaactaaactagtacgacacgtaacggtaccgttcgaaagggaccaaggactaccgaacctactaaccaacacgaaccacgtacaccgaacgacgacaacacgtacctaacgacgtacggaccgtaggacgggacgtccggtaggtaacgttagtttacggaccgaaccgaccggtactaacttacttaacgttaacgtcgtacgggaacgtaaggttacggtacgggtttaccgggaaaccggtaaccggttaaccgttcggaacccggttaacggcggggtaacccgaacggggtacccgttggtaaccccgttccgttaaccccg

SEQ ID NO: 333353 - DNA, 701 bp, Homo sapiens
  misc_feature: GZ8MTXP01BES8Y.4.23.C01.1.454.CMB.2.raw
  modified_base (374)..(374): a, c, t, g, unknown or other
  misc_feature (374)..(374): n is a, c, g, or t
  modified_base (580)..(580): a, c, t, g, unknown or other
  misc_feature (580)..(580): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagccgtggggcctcagtgaaggtctcctgcaaggcttctggctactacctttaccaccttatggtgtcaacgtgggtgcgacacggcccctaggacgaagggcttggagtggagtgggatgggatcgaggcgtacctttaacgaagtagggaaaccaactaaaacgtntacgaccacgtaacgtaccgttcccgaagggtacaacggacgttaccgaaaccctaacttaacccaagaacggaaccacctaactacccgaaccgagaaccaacgaccaccgttaacagtaccgggacctaggaacgggtacgaccgtaggaacgttagttacggaaccgaacggtaccgacgtaacgtattacgttaacgtcggngtaacgtaagacgggtaggttcgggacccggtaaacggttaaccgttcggttaaaccgttcgggtacggggaaccccggtaaacggggtaccccgttacggtcccgttaacccggttcccg

SEQ ID NO: 333354 - DNA, 736 bp, Homo sapiens
  misc_feature: GZ8MTXP01DVAYR.4.23.C01.1.454.CMB.2.raw
  modified_base (185)..(185): a, c, t, g, unknown or other
  misc_feature (185)..(185): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttcttggtggcagcagcaacaggtgcccactcccaggttcacctggancagtctggacctgaggtgaagagccgtgggcctcagtgaaggtctccgtgcaaggtcttcgtcggactactaccctttaccaccttagtggtgtacaacgtgggtgcgacgacggtccccgtaggacgaagggtcttaggaggtggagtgggatggattcgaggtcgtactttaacgaaggttagggaaactaaactaaacttagtaccgactaacgacggtacgttacccgaagggacaacgggactaccaaacctaacttaaccaacgaacgaaccacaacacccgaacggacacaacgacgtaccctaacgagtaccggaccgtagggaacgtacggtaccggtagtaacggttacgtttacgggaaaccgtacccgaacgggtacccttaaagttacgtttaaccgttagtaggttacggaacgtaggttaagggttacggttaccggggaacccggtaaacggttaaacccgttcggaaccgttaacggggaaccgggtaaccgtaacgggtacccgttcggttaacccgttcccgtttaaccccg

SEQ ID NO: 333355 - DNA, 690 bp, Homo sapiens
  misc_feature: GZ8MTXP01EOPT9.4.23.C01.1.454.CMB.2.raw
  modified_base (216)..(216): a, c, t, g, unknown or other
  misc_feature (216)..(216): n is a, c, g, or t
  modified_base (599)..(599): a, c, t, g, unknown or other
  misc_feature (599)..(599): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctnagtgaaggtctcctgcaaggcttctggctacacctttacaccttatggtgtcaacgtgggtgcgacgacggccccgtaggaacgaagggtcttaggaggtagggagttaggggattaggggaacttcgaaggtcggtaccgtttaaacgaaaggttagggggaaaaccaaacgtaaaactataccggacaaacgaacggtaaccgttcccgaaaggggcaaggtacgtaacccaacccgtaacttaacccaacgaacgaacccaactaactacccgaacgaacgacctaaaccgaacgaccctaacgaacgtacgggacctaggaacggacgtccggtagtaagtagttacgaaccgacgaccggtacaattataacttacgngtcgaagagagtacgttcgggaccgtaacggaaactttcggacgttaacggcgggccgaacgggtaccgttcggtaaccgttccgttaacc

SEQ ID NO: 333356 - DNA, 687 bp, Homo sapiens
  misc_feature: GZ8MTXP01CON2F.4.23.C01.1.454.CMB.2.raw
  modified_base (265)..(265): a, c, t, g, unknown or other
  misc_feature (265)..(265): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatcctttttcttggttgcagcagcaacaggtgcccactcccaggttcacctggagcagtctggacctgaggtgaagagcctgggctcagtgaaggtctcctgcaaggcttctggctacaccttaccacctatggtntcaactgggtgcgacgcggccctggacaggcttgagtggagtggatggatcgagcgtactttaacgaagtagggaacaactaaacgtagtacgcacgagtaccggttccgaagggggacaaggacgtaccaaaccacgttaaccaacgtaacgaccaactacacccaacggacgccaacacggtaccctacacgtacgggtaccgtaggaacggacgaccgggtggtaacgttagtttacggaaccgaaccgaccgggacctaacgttacttaacgttaccgtggtacgaacggtaacggaggtaacggttacggggtaacccggaacgggttaaacccggttaggacccggttaacggggtcggggaacccggtaaccgggggtaacccttcgggggtaacccttaaccgggttaaccccg

SEQ ID NO: 333357 - DNA, 761 bp, Homo sapiens
  misc_feature: GZ8MTXP01CS0K1.4.23.C01.1.454.CMB.2.raw
  modified_base (269)..(269): a, c, t, g, unknown or other
  misc_feature (269)..(269): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattcctttttctggtggcagcagcaacaggtgcccactcccaggttccacctggagcagtctggacctgaggtgaagagcgtgggcctcgagtgaggtctctgcaaggtcttctggctactacctttacacctagtggtntacaagtggtgcgacgacggcccctaggacgaagggtcttaggagtggagtgggatggatcgagcgtactttaacgaaagtagggaaaccaactaaacgtataccggactaacgtaggtacccggttaccgaaacggggtacaacggtacgttacccgaaacccttacgttaaaccccgaacacgaaacctaacgacctaaccgaacgacggacctaaacgaaccgtacccttaacgaacgttacggaacccgtacgggaaacgggaacgtaccgggttaacggtaaggtttaacgtttacggaaaccgtaacccgaccgggtaccttaaaggttacttaacttaccgtggtaaccggaacggtaaagggttacggtaaacgggttcggggaaaccccgtaacgggttaaaaccgttcgggaaccggttaaccgggtacggggaacccgaacgggggtaacccttcgggtaaccccgttccgtttaaccccg

SEQ ID NO: 333358 - DNA, 757 bp, Homo sapiens
  misc_feature: GZ8MTXP01BDM6U.4.23.C01.1.454.CMB.2.raw
  modified_base (373)..(373): a, c, t, g, unknown or other
  misc_feature (373)..(373): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggtcttcgtggactacctaccctttaccaccttagtggtgtcaacgtgggtgcgacgcggcccctggaccgaaggtcttagaggtggagtgggatggatcgagcgtacttaacgaagtacgggaaacacaaacttnacgacaacgacgtaccggttcgaaacgggtacaaggaacgtaccaaccgtaataaccccgaaacacgaaccaacctatacccggaacacgtaccaaccgacgtacctacgtaacgtaccggaacgacgggaaaggacgtaccgtaggtaacgggtaactttacgggaaccgaaaccggtaccggtaaccttaaattaacgttaaacgtttaaccgtagggttaacgggaaccggtaaaggttacggggtaaccggtttaacggggaccccggtaaaaacgggttaaacccggttcggttaaaccggtaacccggggtacgggggtaaccccgtaaacgggggtaaccccggttaccgggtaaccgttaacccggttaaccccgg

SEQ ID NO: 333359 - DNA, 660 bp, Homo sapiens
  misc_feature: GZ8MTXP01D9WDA.4.23.C01.1.454.CMB.2.raw
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtgggcctcagtgaggtctcctgcaaggcttcgtggctactaccttaccacctagtggtntacacgtggtncgacgacggccctaggacgaggtcttggagtggagtgggatggatcgagtcgtacgtttaacaaggtacggaaacaactaaacgtagtaccgaccaacgacggtaccgttccggaaagggctaagtacgtacccaaacctacgttaaccaacgtaagaacctacactacccacgacgaccaccgaacgacctacacgtcggaaccgtaggaacgacgtccggtagtacgttacgttacgaacgaaccgtacgacttaagttaattagttccgttggtacggaacgtaggttacgtacggtttacgggaccgtaacggttaaacgttcgaacgtaacggtcgggaaccgtacgggaacccgttggtaaccaaccgttaacc

SEQ ID NO: 333360 - DNA, 622 bp, Homo sapiens
  misc_feature: GZ8MTXP01B7JUO.4.23.C01.1.454.CMB.2.raw
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
  modified_base (608)..(608): a, c, t, g, unknown or other
  misc_feature (608)..(608): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttacacctanggtgtcaactgggtncgacaggcccctggacagggctgagtggatgggntgggatcgagcgacttacaacgtgggaactacgaaactagtaccgactacgagtaccggttcccgaaaggggcgtaagagtccaacccgatttacccacagaaccacgtaactaccacgacgcacgacgactacagtcgacctaggagacgccgtaggagtagtttacgacgaccgacggtaccagttaattagtacctgttcggaaccgagttaggtagttggggaccccgtaacggttaaccgttcgacgttaacggacgggggtcccaagggggtaccccttcggggtaaccncccgggttaacccc

SEQ ID NO: 333361 - DNA, 785 bp, Homo sapiens
  misc_feature: GZ8MTXP01D3EQ9.4.23.C01.1.454.CMB.2.raw
  modified_base (238)..(238): a, c, t, g, unknown or other
  misc_feature (238)..(238): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttctggtgcagcagcaacaggtgcccactcccaggttcacctggagcagtctggacctgagtgaagagccgtgggcctcagtgaaggtctcctgcaggcttcnggtcctactaccttaccaccttatggtcgtcaacgtgggtcgacgacgacggcccccgtaggacgaagggtcctttaggaggtgggagtggggagttacgggatacgaggcgtaccgtttaacgaaacgtaggggtaaaccaacgtaaaaccgtacgtacgaccaacgtaacggtaacccggtttacccgaaaggggtaccctaacggttaacggtaccctaaacccgtacgtttaaccccaaacgtacgtaacccaacaacttaccccgaaacgaacggaccaaacgaccggtaccttaacacggttaccggaacccgtggaaacgggtcgtacccgggttaggaagttaaccgtttacggaaaccggaccctaacgggtaccctaaattacgttacgtttaaacgtggttcggaacggtaggaacggttacggttacggggacccggttaaaccggttaaaccgttcggttaaccgttaacggggtccggggtaaccgtaaccgggggtaaccccgttgggttaaccccgttaaccgtttccccg

SEQ ID NO: 333362 - DNA, 669 bp, Homo sapiens
  misc_feature: GZ8MTXP01DYEL0.4.23.C01.1.454.CMB.2.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtgggcctcagtgagtctcctgcagcttgngactactacctacactagtgtnacagtggtgcgagacgaccgtagacgtaggtctaggnggtaggaggtggtagnggtactacgaggtacgtacgtaaacgtaaggtacggaaacaaacgtaaacgtacgtacgaccgaacgtaacggtaccgttaccggaaaggacgaacggtacgtaacccaaaccgtacctaaccgaacgacgaacccacaactaccgaacggacacctacgaccgtacctaacacggtacgaccgtagggaaacgcgtacgtagtaggttacgttacggaaccgacgacggtactaattactagtcgtgtggaacgtaggttagtacgggttcggaccgtaacggttaacgttcgttaccgtaaggggtaccgggaaccgtaacgggtcccgttacggttcccgaaccggtttcccg

SEQ ID NO: 333363 - DNA, 661 bp, Homo sapiens
  misc_feature: GZ8MTXP01A3EN2.4.23.C01.1.454.CMB.2.raw
  modified_base (184)..(184): a, c, t, g, unknown or other
  misc_feature (184)..(184): n is a, c, g, or t
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (360)..(360): a, c, t, g, unknown or other
  misc_feature (360)..(360): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggancagtctggacctgaggtgaagagccgtggggcctnagtgaggtctctgcaggtcttgngctactacctttaccacttagtggtntcaacgtgggtcgcgacacggccctaggacgagggcttggagtggagtgggatggatcgagcgtacttaacgaagtaggaaacaacaaactncgacacgaggtaccgtcgaaagggcaaggacgtaccaacctataccaacagaaccactacgaccaacggacacactacgacctaacacgtacggacctaggaacggacgacggtaggaagttagttacggaacgaccgtacggacctaaagttacttacgttacggttggcggtaacggaaggacggttacggttcggggaacccgtaacgggttaaaccgttcggttaaccggttaaccggggtcggggaacccgtaaacgggggtaccccgttaggtaaccccgttaacccggttcccg

SEQ ID NO: 333364 - DNA, 629 bp, Homo sapiens
  misc_feature: GZ8MTXP01EHJ09.4.23.C01.1.454.CMB.2.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatcctttttcttggtggcagcagcaacaggtgcccactcccaggttcacctggagcagtctgggacctggaggtgaagagccgtgggcctcagtgaagtctctgnagcttntgctacacttacactngtncagtggtncgacacggccctaggacaggctgagtggagtggatgatcagcgtactttaagaagtaggaaacaagaaactagcgaccacgaagtacgtaccgaagggaccaagacgtccaaaccaacttaaccaagaacgaacaccaactaccaacggacgaccaacgaacgtaccccttaaagaccgttacggaacccgtgggaaacgtcggtaccggtaaggtacgttaagttacggaaaccacgaccggtactaaagttactaacgttacctggtacgaacggtagagtaggttacggggacgaacgttaacgttcggacgtaacgggcggtaacccgacggtaccgttacgggtccaacccggtccg

SEQ ID NO: 333365 - DNA, 673 bp, Homo sapiens
  misc_feature: GZ8MTXP01DG5T3.4.23.C01.1.454.CMB.2.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (534)..(534): a, c, t, g, unknown or other
  misc_feature (534)..(534): n is a, c, g, or t
tcagagcactgtagcacgaccggtgctcgatttagtacacgtgattaggggattggggacccaaaaaccacacccctccttgggcgaatcccctagatcacagctcctcaccatggactggacctggagcattcctttttcttggtggcagcagcaacaggtgcccactccaggttcacctggagcagtctggactgaggtgaagagccgtgggcctgagtgaaggtctcctgcaggtctntgctacnccttacnctagtgtntcaacgtgggtncgacgacggcccgtaggacgaagggtctggagtggatgggatggatcagtctacttacgagtaggaactaacaactatcgacacgtagtaccgtaccgaagggacaaggacgtacccaaactactaaccacgaagaccactacnccacgganaccaacacgaccgtaancgtacggacctagggacgtacgaccgggtagtaacggttacgtttacgggaccgaaccgtaccggtacctaaatttacgtaagtttacgnggtacggaacggtaaggttacgggtacgttacgggaacccgtaagggttaaacccgtttgggaaaccgttccggggtaacggggtccccgtaaaccgggggttaccccgttacgggggttccttaaccccgggttcccg

SEQ ID NO: 333366 - DNA, 654 bp, Homo sapiens
  misc_feature: GZ8MTXP01D8KOH.4.23.C01.1.454.CMB.2.raw
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (435)..(435): a, c, t, g, unknown or other
  misc_feature (435)..(435): n is a, c, g, or t
  modified_base (617)..(617): a, c, t, g, unknown or other
  misc_feature (617)..(617): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttcnggctacacctttaccacctatggtntcaactggtgcgacgacggcccctggacgaagggcttaggagtggagtgggatggaatcgagcgactttaacaagttagggaacaacgaaactatcgacaacgaggtacccgttccgaaaggggcaaggacgtcaaaccattaaccacaagtacacataccacgacnccaactacgaccctacgatacggacctggaacgggtcgacgttaggaagttaacgtttcgggaaccgtaacgaccggtacctaagttaacttaagttacgtagttccggaacgtacggagtacgggtttcgggaaccgtaacgggttaaaccgtttggaaccgttaacgggtcggggaaccncgggggtaaacccttcgggtaaccttaacccgttccg

SEQ ID NO: 333367 - DNA, 605 bp, Homo sapiens
  misc_feature: GZ8MTXP01EMSMI.4.23.C01.1.454.CMB.2.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (394)..(394): a, c, t, g, unknown or other
  misc_feature (394)..(394): n is a, c, g, or t
  modified_base (490)..(490): a, c, t, g, unknown or other
  misc_feature (490)..(490): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagcgtgggcctnagtgaggtctcgtgcaagcttntgctacnctttaccactatggtntcacgtgggtgcgacgacggcccgtaggacgaagggtcttggaggtggagtgggagtggattcgagcgtactttaacgaagtacggggtaacaacgaaactatacgacacgacgtacgttacgaacgggtancggtagttaccaactactaacctaacgacgacgacacgacaacgagacacaacactacgactagcgtacgagacgcgacgtagtagtacgtacganacggacacgattattagtacgtgcgtagacggtaaggttcggtacggtacgttaaacggttacttagtaaccggtcggaacgggtacgaccgttacggtccgttaaccgtaaccg

SEQ ID NO: 333368 - DNA, 646 bp, Homo sapiens
  misc_feature: GZ8MTXP01ET9AE.4.23.C01.1.454.CMB.2.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctnagtgagtctctgcagctngctacnccttacnctatggtntcacgtgggtgcgacacggccctaggacgaagggcttggagtggagtgggagtggatcgagcgtacttaacgaagtacgggaaacaacaaactagtacgaccaacgacgtacgttacccgaagggtacaaggtaacgtaccaacccgtaacttaacccgaacacgaaccactacgacccaacggacgaccaacgtacgaccttacacgtacggaccaggacggaacgtccgtaggtaacgtagttacggaaccgacgacggtacctaagttatacttacgtagtggaacgtaagaggtacgttcgggaaccgtaacggttaaccgttcggaaccgttcgggtacggggaaccgtaacgggacccgttcgggtaacccgttaaccggtcccg

SEQ ID NO: 333369 - DNA, 656 bp, Homo sapiens
  misc_feature: GZ8MTXP01A1S0R.4.23.C01.1.454.CMB.2.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
  modified_base (446)..(446): a, c, t, g, unknown or other
  misc_feature (446)..(446): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctnagtgaaggtctctgcaggcttcnggctacacctttaccacttagtggtcgtctaacgtgggtgacgtacgacgggcccctaggacgaagggcttaggaggtggagttgggatcgggatcgagcgtacttagaagtgggaaacacaaactnacgacacagtactcgaagggaccnggacgtcaaccgtattaccagacacactanccgacgtacgacacgactacctaanacgtacgacgtacggaacggacgtaccgggtaggagtacgttacggaaccgaaccgacgtactaaagtaacttacgttacgtgtacggaacgtaaggttacggtaacggttaccgggtaccgaaaccgggttaaccgttcggttacccgtaacgggtcggggaacccgtaaccggggacccggttacggtaacccgttaacccggtcccg

SEQ ID NO: 333370 - DNA, 649 bp, Homo sapiens
  misc_feature: GZ8MTXP02JR5I8.4.23.C01.1.454.CMB.2.raw
tcagagcactgtagcacgaccggtgctcgatttagtacacgtgattagggattggggacccaaaaccacacccctccttgggcgaatccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggccccctggacgaagggcttgaggtggagtgggatggatcgaggcgtcttaacaagtgggaaacaacaaactatcgacacagacgttcgaggcagagtcaaccattaccacagacacactccacgagcaacagccacagtacggacctggaacgggacgcccgtaggagttagtttacgggaaccgaaccgaccggggaccctaaagttaattaactttaaccgttgtacggtaccggaaaggtaggtaacggtttacgggggacccggtaaaccgggtaaaacccgtttggaaacccgttaacgggtcgggggaccgaaaccgggggtaaccccgttggggtaccccgtaacccgggtttccccg

SEQ ID NO: 333371 - DNA, 542 bp, Homo sapiens
  misc_feature: GZ8MTXP02GUHQX.4.23.C01.1.454.CMB.2.raw
  modified_base (368)..(368): a, c, t, g, unknown or other
  misc_feature (368)..(368): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaaacacaaactatgcacagacgttccagggcngagtcaccattaccacagacacatccacgagcacagcctacatggacctgaggagcctgagattgacgacacggcatactattactgtgacgagagacgttggggaccgacgggaaaaccttggaactaacgtcgggggaccgacggggaaccctcgggtaccaccggttcccg

SEQ ID NO: 333372 - DNA, 551 bp, Homo sapiens
  misc_feature: GZ8MTXP02JS1MM.4.23.C01.1.454.CMB.2.raw
  modified_base (369)..(369): a, c, t, g, unknown or other
  misc_feature (369)..(369): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatggggaaacacaaactatcgcacagacgttcagggcngagtcaccataccacagacacatccacgagcacagcctacatgggaccctgacggagccgtagagatttaggaacgacacggtccagttatattactgtgacgagagacgttgggaccgacggaaaccttggaaccgtaacgtcggggaccgacggggaacccgtcggtaccgaccgttccg

SEQ ID NO: 333373 - DNA, 544 bp, Homo sapiens
  misc_feature: GZ8MTXP02HZ316.4.23.C01.1.454.CMB.2.raw
  modified_base (367)..(367): a, c, t, g, unknown or other
  misc_feature (367)..(367): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatcgcacagacgttcagggcngagtcaccattaccacagacacatccacgagcacacgacctacatacgaccgtagaggagaccgtacgagtagtttagacgacgacggaccactatattactgtgtcgagagagtgggacgacggaacgtacgacgtaacgtcgggaccgacggaccgtcggtaaaacgccgtaccg

SEQ ID NO: 333374 - DNA, 526 bp, Homo sapiens
  misc_feature: GZ8MTXP02JLBN5.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaaacacaaactatcgcacagacgttccagggcagagtcacataccacagacacatccacgagcacagcctacactggacctgaaggagcctgagtatttggaacgacacggccatactattactgtgcgagagagttgggaccgacggaaaccttgactaacgtgggaccacgggacctggtccacgtcc

SEQ ID NO: 333375 - DNA, 536 bp, Homo sapiens
  misc_feature: GZ8MTXP02FUWDS.4.23.C01.1.454.CMB.2.raw
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgcttacaagtgggaaacacaaaactatcgacacagacgttccaggcagagcacataccanagacacatccagagcanagcctanatgacctgagagctgagattgacgacgacggcatatatactgtgacgagagacgttgggaccgacggtaaaccttgaaccgtaacgtcggggaccgaacggggacccgtcggtaccgaccggtccg

SEQ ID NO: 333376 - DNA, 535 bp, Homo sapiens
  misc_feature: GZ8MTXP02IE12S.4.23.C01.1.454.CMB.2.raw
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaaacacaaaactatcgacacagacgttccagggcagagtcaccattaccanagacacanaccacgagcacagcctacatggaccngagacgctgagtattagacgacgacgacatatattactgtgacgagagacgtacggaccgaacgtaacgttgacgtaacgtacgggaccgacggaccgtcggtaccgtacgtcg

SEQ ID NO: 333377 - DNA, 534 bp, Homo sapiens
  misc_feature: GZ8MTXP02J3PDL.4.23.C01.1.454.CMB.2.raw
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacaccttttaccacctatggtgtcaactggtgcgacaggcccctggacaagggcttgagtggatgggatggatcagcgcttacaatgggaaacacaaactatcgcacagacgttccagggcngagtacaccattaccacagacacanccacgagcacacgcctacatgggacctgaggagcctagagtattgacgacacggaccaatatattactgtgcgagagacgtacgggacgacgaaaccttgaactaacgcgggaccacgggaacccgtggtaccaccgtcc

SEQ ID NO: 333378 - DNA, 542 bp, Homo sapiens
  misc_feature: GZ8MTXP02IW7SX.4.23.C01.1.454.CMB.2.raw
  modified_base (463)..(463): a, c, t, g, unknown or other
  misc_feature (463)..(463): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacacggcccctggacaagggcttgagtggatgggatggatcagcgcttacaatgggaaacacaaactatcgacacagacgttccagggcagagtcaccattaccacagacacataccacgagacacagcctaacatcggacctgaggagcctagagtattgacgacgacggcatatattacngtgacgagagagttcgggaccgacggaaaccttgaacctaacggtcggggaccacggggaaccctcggtccaccgtccg

SEQ ID NO: 333379 - DNA, 530 bp, Homo sapiens
  misc_feature: GZ8MTXP02GKOSW.4.23.C01.1.454.CMB.2.raw
  modified_base (367)..(367): a, c, t, g, unknown or other
  misc_feature (367)..(367): n is a, c, g, or t
  modified_base (414)..(414): a, c, t, g, unknown or other
  misc_feature (414)..(414): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaaactatgcacagacgttcagggcntagtcacataccacagacacatccacgagcacagcctacatggaccngagagcctgagattgacgacacggccatatattactgtgcgagagagttggggccgaacgggaaaacccttgaactaacgtcggggaccacggggaaccctgggtaccaccggtcc

SEQ ID NO: 333380 - DNA, 556 bp, Homo sapiens
  misc_feature: GZ8MTXP02JC3H8.4.23.C01.1.454.CMB.2.raw
  modified_base (365)..(365): a, c, t, g, unknown or other
  misc_feature (365)..(365): n is a, c, g, or t
tcagagcactgtagcacgaccggtgctcgatttagtacacgtgattagggattggggacccaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttcagggcngagtcaccattaccacagacacatccacgagcacagcctacatcggacctgaggagcctgagattgacgacacggccagtatattactgtagtcgagaggattacggggaccgtaacggaaaacccttggaaccgtaacgtacgggggacccgtaacgggggaacccctaggggtaccaacccggtttccg

SEQ ID NO: 333381 - DNA, 528 bp, Homo sapiens
  misc_feature: GZ8MTXP02GVU5M.4.23.C01.1.454.CMB.2.raw
  modified_base (369)..(369): a, c, t, g, unknown or other
  misc_feature (369)..(369): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatggggaaacacaaactatagcacagacgttcagggcngagtcaccattaccacagacacataccacgagcacagcctacatgacctgaggagcctgagattgacgacacggccatactattactgtgacgagagagttgggaccgacggaaaccttgactaacgtcggggaccgagggaccctggtccgaccgtcg

SEQ ID NO: 333382 - DNA, 609 bp, Homo sapiens
  misc_feature: GZ8MTXP02G56NW.4.23.C01.1.454.CMB.2.raw
  modified_base (279)..(279): a, c, t, g, unknown or other
  misc_feature (279)..(279): n is a, c, g, or t
  modified_base (446)..(446): a, c, t, g, unknown or other
  misc_feature (446)..(446): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtncgacaggcccctggaccaagggcttgagtggagtgggatggatcgagcgtacttacaagtcgggaaacacaaaactatcgacacgagtaccggttccgaaggggccaggacgtacaaccctaattacccaacgacgacaacactacccaagacgacacagccctaanacgtcgacctgaggacgccgtagagtattaggaacgacgacggaccatataattacgtgtagacgagacggtacgttacggggaccgtaacggtaaaccgttggaaccgtaacggtcggggaaccgtaaccggggtaccctcgggtaccgaccggtttacccg

SEQ ID NO: 333383 - DNA, 660 bp, Homo sapiens
  misc_feature: GZ8MTXP02JO4GM.4.23.C01.1.454.CMB.2.raw
  modified_base (348)..(348): a, c, t, g, unknown or other
  misc_feature (348)..(348): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacaggcccctggacagggcttgagtggatgggatggatcagcgcttacaatgggaaacacaaactntcgcacagacgttcagggcagagtcaccgattaccacagacacataccacgagacacacgacctacacgtacggacctaggaacgggacgaccgtaggaagtagttttacggaaccgaaccgaccgggaccctaaagttaacgttaactttaccgttaggttacggtaccggaaggtaaggtaacggtttacgggggaacccgggtaaaccggggtaaaaccccgtttaggaaacccgttaaccggttacgggggaccccggaaacgggggtaacccccgttacggggttacccgtaaccccggtttccccg

SEQ ID NO: 333384 - DNA, 597 bp, Homo sapiens
  misc_feature: GZ8MTXP02J2M02.4.23.C01.1.454.CMB.2.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgnttacaatgggaacacaaactntcgcacagacgttccagggcngagtcaccataccacagacacatccacgacgcacacgacctacatacggacctggacggacgccgtagacgtatttcggaacgacaccgggaccataatattaactgtcgacggtagaggtacgttacggggaccggaaccggtaaaccgtttacggaaccgttaaccgggtacgggggtacccgaacgggggtaaaccccgttcgggtacccgtaacccggtttcccg

SEQ ID NO: 333385 - DNA, 529 bp, Homo sapiens
  misc_feature: GZ8MTXP02H2KZ3.4.23.C01.1.454.CMB.2.raw
  modified_base (367)..(367): a, c, t, g, unknown or other
  misc_feature (367)..(367): n is a, c, g, or t
  modified_base (456)..(456): a, c, t, g, unknown or other
  misc_feature (456)..(456): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcngagtcaccattaccacagacacatccacgagcacagacctacatcggacctgaggagcctgagatttgacgacacggccatatattacngtgcgagagacttgggaccgacggaaaccttgactaacgtcgggggaccacggggaaccctggtacaccgtcc

SEQ ID NO: 333386 - DNA, 515 bp, Homo sapiens
  misc_feature: GZ8MTXP02HZBTQ.4.23.C01.1.454.CMB.2.raw
  modified_base (368)..(368): a, c, t, g, unknown or other
  misc_feature (368)..(368): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactggtgcgacaggcccctggacaagggcttgagtggatgggatggatcagcgcttacaatgggaaacacaaactatgcacagacgttccaggggcnggagtcaccattaccacagacacatccacgagacacagcctacatgacctgaggagcctgagattgacgacacggcatatatactgtgcgagagagtgggaccgacggaaccttgactaacgtgggacacgggacctggtcacgtcc

SEQ ID NO: 333387 - DNA, 608 bp, Homo sapiens
  misc_feature: GZ8MTXP02JZPEN.4.23.C01.1.454.CMB.2.raw
  modified_base (268)..(268): a, c, t, g, unknown or other
  misc_feature (268)..(268): n is a, c, g, or t
tcagagcactgtagcacgaccggtgctcgatttagtacacgtgattagggattgtggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaactgggtgcgacaggcccctggacaagggcttgagtggatggggatggatcgagcgcttacaagtgggaaacacaaactatgacacacgacgttaccgagggcagacgtcaccacttaccacacgacacactaccacgacgcacacgacctacagtcggacctaggacggacgccgtagagtagtttacgaaccgaccgaccgggacctaatattacttacgtggtacgacggaaggaggtacgttcggggacccgtaaaccgggtaaaccgttacggaaccgttacggtacgggggaccgtaaccggggtaacccgttacgggtaccgtaccccgg

SEQ ID NO: 333388 - DNA, 572 bp, Homo sapiens
  misc_feature: GZ8MTXP02IQRDP.4.23.C01.1.454.CMB.2.raw
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
tcagagcactgtagcacgaccggtgctcgatttagtacacgtgattagggattggggacccaaaaaccacacccctccttgggcgaatcccctaaatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtntcaactgggtncgacaggcccctggacaagggcttgagtggatgggatggatcgagcgctttacaagtgggaaacacgaaactatgacacagacgttcaggcagngtcacattaccanagacacactccacgagcacacgacctacagtacggacctaggaggacgaccgtagacgtattggacgacgaccggacatattacttacgtgtgacgagacgagttacgggaccgaaacggaaccgttcgtaacgtaccgtgggggacccgaacggggtacccgtacggtaccgaccgtaccgtcccg

SEQ ID NO: 333389 - DNA, 686 bp, Homo sapiens
  misc_feature: GZ8MTXP02JSIVS.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacacggcccctggacagggcttgagtggatgggatggatcgagcgcttacaagtggggaaacacgaaactatacgacacaggaccgttccgaaggggcaggacgtaccaacctagttacccaacacgaacaccactacccaacgacgaccaaccacgaccctaacacgtcggacccgtggaagggacgtccgtagagtagtttacggaaccgtacgaccgggtacctaagttaattaacgttaccgttaggtacggtacggtaaggtacggtaacgggtttacgggggaacccggtaaaccggggtaaaacccgtttacgggaacccggttaaccgggtaccgggggtacccggtaaacgggggtaaaccccggttcggggttacccgtacccggtttaccccg

SEQ ID NO: 333390 - DNA, 526 bp, Homo sapiens
  misc_feature: GZ8MTXP02FRZF9.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaagtgggaaacacaaactatcgcacagacgttccagggcatagtcacattaccacagacacatccacgagcacagcctacatgacctgaggagcctgagtattgacgacacggcatatatactgtgacgagagagtcgggaccgaacggaaacttgactaacgtcggggaccgacgggaccgtcggtccacgtccg

SEQ ID NO: 333391 - DNA, 540 bp, Homo sapiens
  misc_feature: GZ8MTXP02IGU9D.4.23.C01.1.454.CMB.2.raw
  modified_base (241)..(241): a, c, t, g, unknown or other
  misc_feature (241)..(241): n is a, c, g, or t
  modified_base (267)..(267): a, c, t, g, unknown or other
  misc_feature (267)..(267): n is a, c, g, or t
  modified_base (391)..(391): a, c, t, g, unknown or other
  misc_feature (391)..(391): n is a, c, g, or t
  modified_base (409)..(409): a, c, t, g, unknown or other
  misc_feature (409)..(409): n is a, c, g, or t
tcagagcactgtagcacgaccggtgctcgatttagtacacgtgattagggattggggacccaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttntggctacacctttaccacctatggtntcaactgggtgcgacaggcccctggacaagggctgagtggatgggatggatcagcgcttacaatgggaacacaaactatgacacagacgttccgagggcagagtcaccattaccacagacacanccacgagcacagccctanatacgacctggaggacgcctagagtatttgacgacacggacatactattactgtgacgagagagttcgggacgacggaaaccttgaacgtaacgtcggggaccacggggaaccctcgggtaccaccggtcc

SEQ ID NO: 333392 - DNA, 563 bp, Homo sapiens
  misc_feature: GZ8MTXP02JIL3U.4.23.C01.1.454.CMB.2.raw
  modified_base (368)..(368): a, c, t, g, unknown or other
  misc_feature (368)..(368): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactggtgcgacaggcccctggacaagggcttgagtggatgggatggatcgagcgcttacgaatgggaaacacaaactatcgcacagacgttcaggcngagtcaccattaccacagacacactccacgagcacacgacctacatcggacctggaggacgccgtgagtagtttgacgacgacggccaagtatattacgtgtgtacgagagacgttcgggaccggacggtaaaccgtggaaccgtaacggtacggggaccgtacggggaacccgtcgggtaccgaccggttcccg

SEQ ID NO: 333393 - DNA, 535 bp, Homo sapiens
  misc_feature: GZ8MTXP02IPJF6.4.23.C01.1.454.CMB.2.raw
  modified_base (343)..(343): a, c, t, g, unknown or other
  misc_feature (343)..(343): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgcttacaatgggaaacanaaactatcgacacagacgttcagggcagagtcaccataccacagacacatccagagcacagcctacatagacctgagagcctgagattgacgacacggcatatattactgtgacgagagagttcgggaccgaacggtaaaccttgacgtaacgtacggggaccgacgggaacccgtcggtaccaccggtccg

SEQ ID NO: 333394 - DNA, 523 bp, Homo sapiens
  misc_feature: GZ8MTXP02I706A.4.23.C01.1.454.CMB.2.raw
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggaccaagggcttgagtggatgggatggatcagcgcttacaatgggaacacgaaactatcgcacagacgttcagggcngagtcaccataccanagacacatccacgagcacagcctacatgacctgaggagcctgagattgacgacacggccatactattactgtgacgagagagtgggaccgacggaaccgtgactaacgtcggggacacggggaaccagtcggactaccg

SEQ ID NO: 333395 - DNA, 542 bp, Homo sapiens
  misc_feature: GZ8MTXP02F82W3.4.23.C01.1.454.CMB.2.raw
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtgatgggatggatcagcgcttacaagtgggaaacacgaaactatacgcacagacgttcgaggcngacgtcaccattacccanagacacatccacgagcacagcctacatcggacctgacggagcctagacgattgacgacacggccaagtatatacgtgtcgcgagagagttcgggaccgacggaaaccttgactaacgtcggggaccgacgggtaaccctgggtaccaccggtcc

SEQ ID NO: 333396 - DNA, 542 bp, Homo sapiens
  misc_feature: GZ8MTXP02J4SN4.4.23.C01.1.454.CMB.2.raw
  modified_base (264)..(264): a, c, t, g, unknown or other
  misc_feature (264)..(264): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
tcagagcactgtagcacgaccggtgctcgatttagtacacgtgattagggattgggtacccaaaaaccacacccctccttggcgaatcccctagatcacagctcctcaccatggactggacctggagcatccttttcttggtggcagcagcaacaggtgcccactcccaggttcacctggagcagtctgacctgaggtgaagaagcctgggcctcagtgaagtctcctgcaagcttctggctacaccttaccacctactgtgtnactaggtgcgcacgacccgtcggcaggacgtgagtggagtggatggatcgaagcgcttacacttggaacacgaaactnaacctcacncacacgacgtacgcgacgacgcgacgacacacacacacacacacacacacgacacacacacgacgacgacgacgacgtcgacgtagtagtagtacgtacgtacgacgtacgtacgtactactacgtagtatacgtagtacgtacgtacgacgtacgtaacgtacgtacgtacgtacgacgtacgtacgtcg

SEQ ID NO: 333397 - DNA, 545 bp, Homo sapiens
  misc_feature: GZ8MTXP02GL4ZL.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgacttacaagtgggaaacacaaactatgacacagacgttcgagggcagagtcacattacaccagacacatccacgagcacagcctacacgtcgacctgacggagccgtgagtatttgacgacgacggaccatactattactgtgcgagagacgttgggaccgacggtaacctgaacgtaacgtcggggaccgacgggtacccgtcggtaccaccggtccg

SEQ ID NO: 333398 - DNA, 584 bp, Homo sapiens
  misc_feature: GZ8MTXP02F0PW1.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgcttacaagtgggaaacacaaactatacgacacagtacgttacgagggcagacgtacaaccattaacccgaacagaaccacactacccaacgacgacacacgcctaacagtcggacctgaggagccgtagagtatttgaacgaccgacggacctagtaatattactgtgacgagagtacgttacgggaccgtaacggaaaccgttgaaccgtaacggtacggggaccgacggggtaacccgtcggtaccaccggtcccg

SEQ ID NO: 333399 - DNA, 544 bp, Homo sapiens
  misc_feature: GZ8MTXP02F3KL5.4.23.C01.1.454.CMB.2.raw
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaaacacaaactatgcacagacgttcagggcngagtcaccattaccacagacacatccacgagcacagcctacatggacctgaggancctagagattgacgacacggccatactatactgtgacgtagagaagttcggggaccgaacgggtaaacccttggaacctaacggtcgggggaccacggggaccctcgggtaccaccggttcc

SEQ ID NO: 333400 - DNA, 557 bp, Homo sapiens
  misc_feature: GZ8MTXP02HBCOX.4.23.C01.1.454.CMB.2.raw
  modified_base (388)..(388): a, c, t, g, unknown or other
  misc_feature (388)..(388): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaagtgggaaactacgaaactatcgacacagacgttccagggcagagtcaccataccanagacacatcccacgagcacacgcctacagtacggacctgaggagcctagagtattgacgacacggccatatattacgtgtagacgagagagttcgggaccgtacggaaaccttcggaacctaacgtcgggggaccctaacggggaccccgtcggtaccgaccggttccg

SEQ ID NO: 333401 - DNA, 543 bp, Homo sapiens
  misc_feature: GZ8MTXP02GV0FJ.4.23.C01.1.454.CMB.2.raw
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgnttacaatgggaaacacaaactntcgacacagacgttcagggcagagtcaccattaccacagacacataccacgagacacacgcctacatgacctgaggagcctggacgatttagaccgacgacggaccataactattactgtgcgagagagttagggaccgacggaaaccgttgacgtaacgtcggggaccacgggaacctcggtaccaccggtccg

SEQ ID NO: 333402 - DNA, 546 bp, Homo sapiens
  misc_feature: GZ8MTXP02HU4UK.4.23.C01.1.454.CMB.2.raw
  modified_base (243)..(243): a, c, t, g, unknown or other
  misc_feature (243)..(243): n is a, c, g, or t
  modified_base (329)..(329): a, c, t, g, unknown or other
  misc_feature (329)..(329): n is a, c, g, or t
  modified_base (404)..(404): a, c, t, g, unknown or other
  misc_feature (404)..(404): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttcnggctacacctttaccacctatggtgtcaactgggtgcgacaggcccctggacaagggcttggagtggatgggatgggatcgagcgnttacaagtgggaacacgaaactatcgcacagacgttcaggggcagagtcaccattaccacagacacatccacgancacagcctacatggacctgaggagccttgagtatttacggacgacacggccatatattactgtgcgagagacgttggggaccgtaacggaaccttggacctaacgtcggggaccgacggggaccctggtaccgacggttccc

SEQ ID NO: 333403 - DNA, 670 bp, Homo sapiens
  misc_feature: GZ8MTXP02JR6AH.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacacggcccctggacaagggcttggagtggatgggatggatcgagcgcttacgaagttgggaaacacgaaaactatacgacaacgagaaccgttccgaggggccaggacgtccaacccgtattaacccaactacgaccaacgaactacccgaacgacgacaaccacgccctaacacgttacgggaacccgttggaacgggacgacccgttaggacgtagtttacgaacgaaccgaccggaccaagttactaacgtttacgtaggtacggaccggtaaggaggtacgtttacgggggaaccggtaaccgggtaaaaccgttcggtaaccgtaacggtaccgggggaccgaacgggggtaacccgtcggggttaccgaacccggtttcccg

SEQ ID NO: 333404 - DNA, 589 bp, Homo sapiens
  misc_feature: GZ8MTXP02I4NVP.4.23.C01.1.454.CMB.2.raw
  modified_base (286)..(286): a, c, t, g, unknown or other
  misc_feature (286)..(286): n is a, c, g, or t
  modified_base (457)..(457): a, c, t, g, unknown or other
  misc_feature (457)..(457): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcgagtgaaggtctcctgcaaggcttctggctactacctttaccacctatggtgtcaacgtgggtgcgacncggcccctggacagggcttgaggtggagtgggatgggatcgagcgacttacaagtgggaaacacaaactatcgacaacgagaccgttcgagggaccaggacgtcaccacttaaccacagaccaacatacccacgacgacaactacgcctaacacgtacggactggaagggngaccgtagacgtagtttacgaacggaccgaacggctaatacttatactgtgacgtaggagtacgttacgggaccgtaacgaaccttgaacgtaacgtcggggaccacggggaccctggtccgacggttcccg

SEQ ID NO: 333405 - DNA, 639 bp, Homo sapiens
  misc_feature: GZ8MTXP02FSTR5.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacacggcccctggacaagggcttgagtggatgggatggatcgagcgcttacgaagtgggaaacacaaactatcgacacagacgttccaggcagagtcacattaccacacgacacataccacgacgcacacgacctacactacgggaccctaggacggacgccgtaggagtacgtttacggaaccgaccgaccgggacctaagttaattaactttaaccgtaggttacggacggtaggaaggtaacggtttacgggggaccggtaaaccgggtaaaacccgttcggtaaaccgtaaccggttacgggggaacccgaacgggggtaaccccgtacggggtacccgtaacccggttcccg

SEQ ID NO: 333406 - DNA, 636 bp, Homo sapiens
  misc_feature: GZ8MTXP02GBNYW.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaagtgggaaacacaaactagtcgcacgagacgttccaggggcaggagtcaaccacttaccacagacacactccacgagcaacacgcctaacactggaccctggaacggacgacccgtaggagtaatttacggaaccgaaccgaaccggaccctaagttaataacgtttaccgtagttacggaccgtaaggtaaggtaacggtttacggggacccggtaaccgggtaaaaccccgttggtaaaccgtaacggtacgggggacccgaacggggtaaccccgttacgggtacccgaacccggtttcccg

SEQ ID NO: 333407 - DNA, 697 bp, Homo sapiens
  misc_feature: GZ8MTXP02HEF49.4.23.C01.1.454.CMB.2.raw
  modified_base (411)..(411): a, c, t, g, unknown or other
  misc_feature (411)..(411): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacgacggcccctaggacgaagggcttgaggtggagtggggatggatcgaggcgtacttacgaaagtcgggaaacacgaaaactatacgacacgagtaccgttccgagggcagagtcaccgtataaccanacgacacactaccacgacgacacacgacctaacacgtacggacccgtggaacggacgtaccgtaggtacgtaagtttacgggaaaccggaaccgtaaccggggtaccctaaattaacgttaaacgtttaccgttaggttacggtacggaaacgggtaaggtacggtttacgggggacccggaaaccgggtaaaacccgtttacggtaaaccgttaaccggggtacgggggtaacccgtaaccgggggtaaccccgttacggggtacccgtaaccccgggtttcccg

SEQ ID NO: 333408 - DNA, 585 bp, Homo sapiens
  misc_feature: GZ8MTXP02JLNN3.4.23.C01.1.454.CMB.2.raw
  modified_base (504)..(504): a, c, t, g, unknown or other
  misc_feature (504)..(504): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacaggccccctggacaagggcttgagtggatgggatggatgagcgtcttacaagtgggaaacacaaaactatacgacacagaccgttaccaggggcaggacgtacaaccaacttaaccacaagaaccacactacccacgacgacaacacgacctacagtacgacctgaacggacgaccgtagagtagtttaggaaccgacgacggtaccaattatattaacncgtagcgagagagtcgggacgacgtaaacgtgaacgtaacggtacgggaccgaacgggaccgtcggtaccgaccgttaccg

SEQ ID NO: 333409 - DNA, 528 bp, Homo sapiens
  misc_feature: GZ8MTXP02IHXNU.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacaccttaccacctatggtgtcaactggtgcgacaggcccctggacaagggcttggagtggagtgggatggatcgagcgcttacaatgggaaacacaaactatcgacacagacgttccagggcagagtcaccattaccacagacacatccacgagacacacgcctaacactggacctgaggacgcctgagtatttgacgacgacggcatatattacgtgtgacgagagacgtggacgacggaaaccgttgactaagtcgggacgaggacctcggtacacgtc

SEQ ID NO: 333410 - DNA, 543 bp, Homo sapiens
  misc_feature: GZ8MTXP02G6V12.4.23.C01.1.454.CMB.2.raw
  modified_base (267)..(267): a, c, t, g, unknown or other
  misc_feature (267)..(267): n is a, c, g, or t
  modified_base (322)..(322): a, c, t, g, unknown or other
  misc_feature (322)..(322): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtntcaactgggtgcgacaggcccctggacagggctgagtgatgggatggatcagcgnttacaatgggaaacacgaaactntcgacacgagacgttccaggggcnggacgtcaacattaccacagacacataccacganccaacacgcctacacgtagaccgtgacggagcctagagtatttaggaacgaccgacggaccataactattactgtgacgagagagttcgggaccgacggaaacctgactaagtcgggaccagggacctcggtacacgtcc

SEQ ID NO: 333411 - DNA, 538 bp, Homo sapiens
  misc_feature: GZ8MTXP02IDS6A.4.23.C01.1.454.CMB.2.raw
  modified_base (392)..(392): a, c, t, g, unknown or other
  misc_feature (392)..(392): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgagtgaagaagcctggggcctcagtgaaggtctcctgcaaggcttctggctacacctttaccacctatggtgtcaactggtgcgacaggcccctggacaaggcttgagtggatgggatggatcagcgcttacaatgggaaacacaaaactatgcacagacgttccaggggcagacgtcaccattaccacagacacanccacgagacaacagcctacatcggacctgaggagcctgagattagacgacacggcatactattactgtgacgagagattcggggaccgacggaaaccttgaacctaacggtcgggaccgacgggaacccgtcggtaccaccgtccg

SEQ ID NO: 333412 - DNA, 556 bp, Homo sapiens
  misc_feature: GZ8MTXP02JOYWW.4.23.C01.1.454.CMB.2.raw
  modified_base (437)..(437): a, c, t, g, unknown or other
  misc_feature (437)..(437): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaaacacgaaactatcgcacagacgttccgagggcatacgtcacctattaaccacagacacactaccacgacgcaacagcctacatcggacctgaggagccngagagtttgacgaccacggacctatacgttattacgtgtagcgaggagtacgtcggggaccgacggtaaaccttgactaacgtcggggaccgacgggacccgtacggtctaccggtccc

SEQ ID NO: 333413 - DNA, 547 bp, Homo sapiens
  misc_feature: GZ8MTXP02IJ8I2.4.23.C01.1.454.CMB.2.raw
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (436)..(436): a, c, t, g, unknown or other
  misc_feature (436)..(436): n is a, c, g, or t
  modified_base (462)..(462): a, c, t, g, unknown or other
  misc_feature (462)..(462): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaactgggtgcgacaggcccctggacaagggcttgagtggatgggatggatcagcgcttacaatgggaaacacgaaaactatcgacacgagacgttccagggcngagtcacataccanagacacataccacgagcacacgcctacagtgacctgaggacgcctagganagttgacgacacgaccatatattacngtgacgagagacgttcgggaccgacggaaaccttgaacttaacggacggggaccgacgggtaacccgtcggtaccaccggttccg

SEQ ID NO: 333414 - DNA, 698 bp, Homo sapiens
  misc_feature: GZ8MTXP02JK9RV.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcggcttacaatgggaaacacaaactatcgacacagacgttcagggcagagtcaccgataccacagacacatacccacgacgacaaccagaccctaacacgtacgggaccctggaacggacggacccttgggaacggtaagttttacgggaaccgaaccgaaccggggaccctaaaggtttaaactaacggtttaccttagggttacggtaaccggtaacggaggtaaaacgtttacgggggtaccccggaaaaccggggtaaaacccccgttttggggaaaacccgtttaaccggttaccggggggaaccccgtaaacggggggtaaaccccccgttacgggggttaaccccgtaaccccggtttaacccccgg

SEQ ID NO: 333415 - DNA, 633 bp, Homo sapiens
  misc_feature: GZ8MTXP02I2PF3.4.23.C01.1.454.CMB.2.raw
  modified_base (242)..(242): a, c, t, g, unknown or other
  misc_feature (242)..(242): n is a, c, g, or t
  modified_base (358)..(358): a, c, t, g, unknown or other
  misc_feature (358)..(358): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttntggctacacctttaccacctatcggtgtcaacgtgggtgcgacaggcccctggacaagggtcttggagtggagtgggatggatcagcgacttacaagtgggaaacactaaaactancgacacgagtacgttacgagggcagacgtcaaccataacccacgaacgaaccacactacccaacgacgacaacgacgaccctaacacgtacggaccgtaggaacggacgaccgtaggagtagtttacggaaccgacgaaccggaccgaataacttattacgtagttagtacggagaaggtaggttacgggaccggtaacggtaaaccgttcggaaccttaacgggacggggtaccggtaacggggaacccgtacgggtaccgtaaccggttcccg

SEQ ID NO: 333416 - DNA, 654 bp, Homo sapiens
  misc_feature: GZ8MTXP02FXJP3.4.23.C01.1.454.CMB.2.raw
  modified_base (352)..(352): a, c, t, g, unknown or other
  misc_feature (352)..(352): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacaggcccctggaccaagggcttgagtggatgggatggatcagcgcttacaagtgggaaacacaaaactntcgcacagacgttccagggcagagtcaccataccaacagacacatccacgacgcaacacgaccctaacacgtggaaaccctggaacgggacgaccgttaggaacgtagtttacggaaccgaaccgaccgggacccaaagttaaactaatttaaaccgtcggttagtaccggaaggaacgggtaagtttacgggggacccggtaaacgggtaaaaacccgtttcggaaaccgttaacggttacgggggaccccgtaaacgggggaaacccccgttcggggtacccgtaacccggtttaccccg

SEQ ID NO: 333417 - DNA, 725 bp, Homo sapiens
  misc_feature: GZ8MTXP02FNVCA.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagccgtggggcctcagtgaaggtctcctgcaaggcttctggctacacctttaccaccttatggtgtcaacgtgggtgcgacgacggcccctggacgaagggcttggaggtggagtgggatggatcgagcgacttacaagtagggaaacaacgaaaactatacgacaacgagtaccgttacgagggacaggacgtcaacctacttaacccaacgacgaacaacaactacccaacgacgaccaaccgacgaccctaacaacgtacgggaacccgtaggaaacgggaccgtacccgtaggaagtaacgttttacggaaaccgaacccgaaccgggaccctaaagttaagttaactttaacgtggttacggacggaaggtaaggtaacggttacgggggaaccccggtaaaaccgggggttaaaaccctttacgggtaaaccgttaaccgggtaccgggggaacccggtaaacccgggggtaaaccccggttccggggttacccgtaaccccgggtttccccg

SEQ ID NO: 333418 - DNA, 552 bp, Homo sapiens
  misc_feature: GZ8MTXP02G35YI.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactggtgcgacaggcccctggacaagggcttgagtggatgggatggatcagcgcttacaatgggaaacacgaaactatacgcacagacgttccagggcagagtcaccattaccacagacacatccacgagcacagcctacatggacctgaggacgcctgagatttagacgacacggccaatatattactgtgtacgagagtagttggggaccgaacgggaaccttagaacgtaacggtacggggacccgaacggggaaccctcggtaccgaccggtacccg

SEQ ID NO: 333419 - DNA, 661 bp, Homo sapiens
  misc_feature: GZ8MTXP02J1OR4.4.23.C01.1.454.CMB.2.raw
  modified_base (354)..(354): a, c, t, g, unknown or other
  misc_feature (354)..(354): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacagggcttgagtggatgggatggatcgagcgcttacaagtgggaacacaaactatcgcanagacgttcgaggcagagtcaccattaccacagacacactccacgacgacacacgacctaacgaagtcggaccctaggaacgggacgtaccgtaggagtaagtttacggaaccgaacgacccgggtaccctaaagttaacttaacgtttaaccgtaggttacggacggaaggtaacggtacggtttacgggggacccggtaaaccgggtaaaacccgttttacggaaaccgttaaccgggttccgggggtaacccggaaccgggggtaaacccccgttcggggtaccccgtaacccgggtttaccccg

SEQ ID NO: 333420 - DNA, 666 bp, Homo sapiens
  misc_feature: GZ8MTXP02G7OCB.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacacggcccctggacaagggctggagtggagtgggatggatcgagcgtacttacgaagtagggaaacacaaactatcgacacgagaccgttcgagggcaggacgtacgaacctaagttaacccaacgaacgaacaaccactacccgaacgacgaccaacacgaccctaacacgtacgacccgtaggaacggacgaccgtaggagtagtttcgaaccgacgaccggacctaataacttaacttacgtagtacgacggtaggaagtacggttcggggaacccggtaaaccgggtaaaaccgttcggtaaaccgtaaccgggttacgggggaacccgtaaccgggggtaaaccccgtacgggttacccgaacccgggtttacccccg

SEQ ID NO: 333421 - DNA, 668 bp, Homo sapiens
  misc_feature: GZ8MTXP02JRT3S.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcagtgaaggtctcctgcaaggcttctggctacacctttaccactatggtgtcaacgtgggtgcgacacggcccctggacaagggcttggagtggatgggatggatcgagcgcttaacgaagtgggaaacacaaactatcgacacagacgtcgaggcagacgtcaccattaccacacgacacactaccgacgacgacaacacgaccctaacgacgtacggaccgtaggaacgggacgaccgtaggtagtacgtttacggaaccgaaccgaccgggtaccctaaagttacgttaactttaccgtaggtacggtaacggaggtacggtaacggtttacgggggaacccggtaaacgggtaaaacccgtttacggaaaccggtaacgggttaccgggggaacccggtaacgggggtaaaccccggttcgggtaccccgtaacccgggtttccccg

SEQ ID NO: 333422 - DNA, 625 bp, Homo sapiens
  misc_feature: GZ8MTXP02IF7DG.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctactacctttaccacctatggtgtcaacgtgggtgcgacgacggcccctggacaagggcttggagtggagtgggatggatcgagcgacttacaagtagggaaacacaaactatacgacacgacgtacgttccgagggacaggacgtaccaaccgtaacttacccaacgacgaaccacactcccaacgacgaccaacacgccctaacacgtacggaccgtacggaagggacgacccgtagtaacgtagtttacgaaccggtaaccgaccggacctagtaacttagttactgtcggacgtagagtacgttacggggaccgtaacgggtaaacttcgaacgtaacggtcgggaccgacggtaccgtcggtaccgaccgttccg

SEQ ID NO: 333423 - DNA, 581 bp, Homo sapiens
  misc_feature: GZ8MTXP02HX2X3.4.23.C01.1.454.CMB.2.raw
  modified_base (279)..(279): a, c, t, g, unknown or other
  misc_feature (279)..(279): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtncgacaggcccctggacaagggcttggagtggatgggatggatcagcgcttacaatgggaaacacaaactatacgacacagacgtttccgagggcaggacgtacaccacttaaccacacgacacatccacgagacacagcctaacatacggacctagaggacgaccgtagagtatttacgaccgaacgacggaccataatattaactgtgacgagtagagttcgggaccgtaccggtaaaccgttcgaacgtaacggtacggggaccgtacggggtaacccgtacggtacctaaccggtcccg

SEQ ID NO: 333424 - DNA, 653 bp, Homo sapiens
  misc_feature: GZ8MTXP02HHDRB.4.23.C01.1.454.CMB.2.raw
  modified_base (278)..(278): a, c, t, g, unknown or other
  misc_feature (278)..(278): n is a, c, g, or t
  modified_base (402)..(402): a, c, t, g, unknown or other
  misc_feature (402)..(402): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactggtncgacaggcccctggacaagggcttgagtggatggggatggatcgagcgcttacgaatggggaaacacaaaactatgacacagacgttccaggggcaggatcaaccattaaccgacagtacccanatccaacgacgcaacagcctaacatacgggacctggaggacgtaccgtggtaagagtttaggaacgaaccgaaccgggaccctaactaaagttaaccttaaacgtggttaggaccggaaaggtagtaaggtttacgggggacccggtaaacggggaaaacccgtttaggaaacccgttaaaccggtcgggggtaacccgaaacgggggtaaaacccccgttcggggtacccgtaaaccccgggtttccccg

SEQ ID NO: 333425 - DNA, 737 bp, Homo sapiens
  misc_feature: GZ8MTXP02FX321.4.23.C01.1.454.CMB.2.raw
  modified_base (446)..(446): a, c, t, g, unknown or other
  misc_feature (446)..(446): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtgggtgcgacacggcccctggacaagggcttggagtggagtgggatggatcgagcgacttacgaagtagggaaacactaaaactatcgacacgagaccgttacgaggggacaggacgtacaacctacttaccgaacagaaccacactacccgacgacgacacacgccctaanacgtacggaaccgtaggaacgggacgtacccgtaggtaacggttaacgtttacgggaaccgaacccgaaccgggtaccctaaagttaaacgtttaactttaaacccggtggttacgggaaccggtaaagggtaaaggggttaaacggtttaccgggggaaaccccgggtaaaccgggggttaaaaaccccgtttacggtaaaacccggttaaccggggtaccgggggaaccccggtaaaaccgggggtaacccccgtttacggggtaaccccgtaacccggtttcccccgg

SEQ ID NO: 333426 - DNA, 763 bp, Homo sapiens
  misc_feature: GZ8MTXP02H37EJ.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgagtgaagaagcctgggcctcgagtgaaggtctctgcaaggcttcgtggctactacctttaccacctatggtgtcaacgtgggtgcgacacggcccctaggacgaagggcttggagtggatgggatggatcgagcgtcttacgaagtagggaaacacgaaaactagtacgacacgagacgttacgagggacagaacgtaccaacctacgttaaccaacgaacgaccaaccgtaacaccgaaccgacgaccaaccacgaccctaacgaacgtcggaccgtaggacggacgtacccgtaggtaacgtagtttacggaaccgaacgaaccggtacctaacgtttaaacgttaacgttttaaacgttcggtaacggtaccgggaaaagggtaacggttaaacgtttaccggggggaaaccccggtaaaaacccggggttaaaaccccgttttccggggtaaaacccggttttaaacccgggggaccgggggtaaaccccgggtaaacccggggggttaaaacccccgtttaccgggggttaaaccccggttaccccccggtttaacccccgg

SEQ ID NO: 333427 - DNA, 541 bp, Homo sapiens
  misc_feature: GZ8MTXP02ILZGA.4.23.C01.1.454.CMB.2.raw
  modified_base (469)..(469): a, c, t, g, unknown or other
  misc_feature (469)..(469): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgcttacgaatgggaacacaaactatgacacagacgttccaggcagagtcacacttaccacagacacatccacgagacacagacctacatcggacctgagagcctagagtatttgacacgacggacatatattactgtgacgagngacgttgggaccgtacggaaaccttgacgtaacgtggggaccgtacgggaaccctcgggtaccacggtcccg

SEQ ID NO: 333428 - DNA, 594 bp, Homo sapiens
  misc_feature: GZ8MTXP02GKD88.4.23.C01.1.454.CMB.2.raw
  modified_base (378)..(378): a, c, t, g, unknown or other
  misc_feature (378)..(378): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacacggcccctggacgaagggcttggagtggagtgggatggatcgagcgacttacgaagtgggaaacacaaactatcgacacagacgttcgaggcngagtcaccataccacagacacactaccacgacgacacgacgcctacagtacggacctggaaggacgccgtaggagtacgtttacggaaccgacgacggacctaattaactattacgtagtagacgaggagtacgttcgggaccggaaccggtaaaccgttcggtaaccgtaacggtacggggaccgtacggggtacccgtcggtaccgaccgtccg

SEQ ID NO: 333429 - DNA, 604 bp, Homo sapiens
  misc_feature: GZ8MTXP02FE3SU.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgacttacaagtgggaaacacaaactatcgacacaggacgttcgaggggcagacgtcaacctattaaccacagacacatccacgagcacacgacctacactcggaccgtggacggacgaccgtgagtatttacgggacgaccgaccggacctaagtaactaattacgtagtcggtacggaaggtacggtagttacggggaccggtaaccgggtaaaaccttcggaactaacggtacgggggacccgacggggtaacccgtcgggtaccgacccggttcccg

SEQ ID NO: 333430 - DNA, 648 bp, Homo sapiens
  misc_feature: GZ8MTXP02IGUQP.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtgggcctcagtgaaggtctcctgcaaggcttctggctactacctttaccacctatggtgtcaacgtgggtgcgacacggcccctggacaagggcttgagtggagtgggatggatcgagcgtacttaacgaagtgggaaacaacgaaactagtccgacaacgagaccgttacgaggggacaggacgtacaaccctaattaacccacgaacgaaccaactaactacccgaacgaacgacaaccgacgaccctaacaagtacggaccgtagaacggacgtaccgtggtaagtacgtttacggaaccgaccgacggacctaagtaacttattacgtgtacgacgagaggtacgtacggggaccgtaaaccggtaaaccgtttagaaccgtaacggtcggggacccgtaacggggtaacccgtcggtacccgtaacccgtcccg

SEQ ID NO: 333431 - DNA, 703 bp, Homo sapiens
  misc_feature: GZ8MTXP02IDZOC.4.23.C01.1.454.CMB.2.raw
  modified_base (245)..(245): a, c, t, g, unknown or other
  misc_feature (245)..(245): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcgagtgaaggtctcctgcaaggcttcnggctactacctttaccacctatggtgtcaactgggtgaccgacacgggcccctggacgaagggcttggagtggagtggggatggatcgaggtcgtactttaacgaagtaggggaaaaccaacgtaaaactatacgaccaacgagacggtttccgaggggtacagtacgtacaccctaaattacccgacaacgacaacactacccaacgacgaccaacacgacctaacacgtacgggacctaggagggacgtccgtaggagttacgtttacggaaccgtaaccgacggtaaccagttaaacgttatttaaacgtggttaacggtacggaaggtaaacggtacggtttaccggggaacccggttaaaccgggaaaacccgttttggaaaccgtttaaccgggtcgggggaacccggtaaccggggtaaccccgtagggtacccgtaacccgggtttcccg

SEQ ID NO: 333432 - DNA, 726 bp, Homo sapiens
  misc_feature: GZ8MTXP02G3K9L.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcagtgaaggtctcctgcaaggcttctggctactacctttaccacctatggtgtcaacgtgggtgcgacacggcccctggacagggcttgagtggagtgggatggatcgaagcgtacgtttaacaagtagggaaactaacaaaacttagtaccgaccaactaacggtaaccggttaccgaaggggacaggacgttaccaaaccgtaacttaacccgaacaacgaaccaacaactacccaaacgacgaccaaccgacgtaccctaaacacgtacggacccgtaggaacggacgtacccgttaggaagttaacgtttagggaaaccccgtaacgaacccgggtaccctaaagtttaacgttaactttaaccgtgtacggtaccggaaggtaaggtacggttacggggacccggtaaaccgggtaaaaccgttcggtaaaccggtaaccggttacgggggaaccccggtacggggtaaccccgttaccgggtaccgtaccccggtttaccccg

SEQ ID NO: 333433 - DNA, 560 bp, Homo sapiens
  misc_feature: GZ8MTXP02GHJLV.4.23.C01.1.454.CMB.2.raw
  modified_base (388)..(388): a, c, t, g, unknown or other
  misc_feature (388)..(388): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctctgcaaggcttctggctacacctttaccactatggtgtcaacgtggtgcgacacggcccctggacaagggcttaggagtggatgggatggatcagcgcttacaagtgggaaacacgaaactatcgacacagacgttcgagggcagcgtacacataccanagacacatccacgagcacagcctacatggacctgaggacgcgtacgagattacgacgacgacgaccgaatatagtactgtgacgagagtagtacgggaccgaacggtaaaccgttgaacgtaacgtacggggaccgtaacggggaaacccgtcggtaccgtaccgttacccg

SEQ ID NO: 333434 - DNA, 674 bp, Homo sapiens
  misc_feature: GZ8MTXP02GYCAR.4.23.C01.1.454.CMB.2.raw
  modified_base (365)..(365): a, c, t, g, unknown or other
  misc_feature (365)..(365): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttcgtggctacacctttaccaccttatggtgtcaacgtgggtgcgacacggccccgtggaccgaagggcttggagtggagtgggatggatcgagcgacttaacaagtagggaaacaacaaaactntacgacaacaggaccgttaccgagggcaggacgtacaaccgacttaaccaacacgaaccacactacccaacgacgacaccacgaccctaacacgtacgacctaggaacgggacgtaccgtaggaacgtacgtttacggaaccgaaccgaaccggtaccaaagttaacttaacgtttaacgtaggttacggacggaaggtaaggtacggttacgggaaccggtaaccggtaaaaccgttacggtaaccgttaacggtacggggacccggtaaacggggtaacccgtccgggtaccgtacccgtttacccg

SEQ ID NO: 333435 - DNA, 648 bp, Homo sapiens
  misc_feature: GZ8MTXP02JQYNP.4.23.C01.1.454.CMB.2.raw
  modified_base (356)..(356): a, c, t, g, unknown or other
  misc_feature (356)..(356): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctacacctttaccacctatggtgtcaacgtgggtgcgacacggcccctggacagggcttggagtggagtgggatggatcgagcgacttacaagtgggaaacacaaactancgcacagacgttccgagggcaggacgtacaacctacgttaccaacgagaccaacactacccgaacgacgacacacgccctaactacgtacggtacccgtaggaacgggacgaccgtaggacgtagtttacggaacgaaccgaaccgggaccctaagttaacttaacgttaacgtggtacggtacggaaggacggtaacggttacggggaacccggtaaccggtaaccgttacggaaccgtaacggtcggggacccgtaacggggtacccgtacggtaccgaccggttacccg

SEQ ID NO: 333436 - DNA, 655 bp, Homo sapiens
  misc_feature: GZ8MTXP02HJ3YX.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacacggcccctggacaagggcttggagtggagtgggatggatcgagcgcttaacgaagtgggaaacacaaaactatcgacacagtaccgttccgaggggcaggacgtacaacctacttaacccaacaacgaaccacaactacccaacgacgacaacacgaccctaacacgtacggacccgtaggaacgggacgccgtaggtaagtagtttacggaaccggaacgaccggacctaagttaacttaacgttaacgtggtaggtacggaaggtaggtacggttacgggggacccgaaaccgggtaaaccgttcggaaccgttaacggtcgggggaccggaacggggtaacccgtcgggtaccgtacccggttcccg

SEQ ID NO: 333437 - DNA, 660 bp, Homo sapiens
  misc_feature: GZ8MTXP02G2A25.4.23.C01.1.454.CMB.2.raw
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacacggcccctggacaagggcttggagtggatggggatggatcgagcggtactttacgaagtcgggaaacaacaaactatcgacacagacgttccaggcngagtcacataccanagacacanaccacgacgacaacacgccctaacacgtacggacccgtaggaacgggacgaccgtaggagtagtttacggaacgtaacgaccggacctaataacttaactttaacgtggttacgaccggtaaggtaggtaaacggttacgggggtacccggtaaaccgggtaaaacccgtttacggaaaccggttaaccgggtacgggggaacccgtaaaccgggggtaaaccccgtcggggttaccccgtaacccgggtttccccg

SEQ ID NO: 333438 - DNA, 683 bp, Homo sapiens
  misc_feature: GZ8MTXP02F2SLF.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctaccacctttaccaccttatggtgtcaacgtgggtgcgacgacggccccctggacaaggggcttaggaggtggagtgggatggatcgagcgacttacaagtgggaaacacaaaactatacgacacaagaccgttaccgaaggggcaggacgtaccaaacccgtaacttaacccaacacgaaccaaccaactacccaacgaacgacaacgacgaccctaacacgtacggaacccgtaggaacggacgacccgtaggacgtaacgtttacggaaaccgaaccgaccgggtaccctaaagttaacgttaacttaaccgtagttacggacggtaaggaagtaaggttacgggaaccggtaacggtaaaaccgttcgaaccgttaacggtacggggacccgtaacggggtaacccgttacgggtacccgtaacccggttccg

SEQ ID NO: 333439 - DNA, 666 bp, Homo sapiens
  misc_feature: GZ8MTXP02G7W6T.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacaccctttaccacctatggtgtcaacgtgggtcgcgacgacggcccctggacagggcttggagtggagtgggatggatcgaggcgtacttaacgaagtcggggaaacctaacaaaacttatacggaccaacgtacgtaacgttacccgaaggggtcacggtacggtaccaaacccgtacttaacccaacgaacgaacctaacactacccgacgaacgaccaacgacgaccctaacgagtacggaccgtaggaacggacgaccgtaggacgtacgttacgaacgtaccgacggactaatacttacttacgtgtacgtacggacgtagtacggtacgggaccgtaacggtaaaccgttcggtaaccgtaacgggtccggggaaccgtaccggggtacccgtcggtacccgtaccgtacccg

SEQ ID NO: 333440 - DNA, 563 bp, Homo sapiens
  misc_feature: GZ8MTXP02H5XC2.4.23.C01.1.454.CMB.2.raw
  modified_base (372)..(372): a, c, t, g, unknown or other
  misc_feature (372)..(372): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttggagtggagtgggatggatcagcgcttacaagtgggaaacacaaactatcgacacagacgttcgaggcngagtcaccataccacanacacanccacgancacagcctaacatcggacctgaaggngcctgagtattgacgacgacggcatatattactgtgcgagagtagttacgggaccgtaacgaaaccgtttgaaccgttaacggtaccgggggaccgtaacggggaaccccgtcgggtaccgtaaccccggttccc

SEQ ID NO: 333441 - DNA, 743 bp, Homo sapiens
  misc_feature: GZ8MTXP02I0SSZ.4.23.C01.1.454.CMB.2.raw
  modified_base (289)..(289): a, c, t, g, unknown or other
  misc_feature (289)..(289): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtgggcctcagtgaaggtctcctgcaaggcttcgtggcctacctacctttaccacctagtggtgtcaacgtgggtgcgacncggccctaggacgaggcttggagtggagtgggagtggactcgagcgtacgttaacaagtagggaaaccaacgtaaaactatacgaccgaacgagtaccgttacgacgggacaggtacgtaccaactaccttaaccaacacgacaacactacccgacgacgacaacgacgtacctaaacgagttaccggaaccgtagggaaacggacgtaccgtacggtaagtacgtttaaccggaaccgtaaccggaaccggtaactaactttaaaacgtttacgtttaaacgtcggttaacggaacggtaaaggtaacggttacgggttaaccgggggtaaacccggttaaaaccggggttaaaaccgttaccggtaaaaccggttaaccggggtaccgggggtaaaccggtaaacccggggtaaccccggtttacggttaccccgtaaccccggtttccccg

SEQ ID NO: 333442 - DNA, 588 bp, Homo sapiens
  misc_feature: GZ8MTXP02JIVNF.4.23.C01.1.454.CMB.2.raw
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaactgggtncgacaggcccctggacaagggcttgagtggatgggatggatcagcgcttanatgggaacacgaaactntcgcacagacgttccagggcngagtcacataccacagacacatccacgacgcacagccctacgactggacctgaacggacgccgttggaagtagtttacgggaaccgaccgaaccggaccaattaatacttaacgtgtacggacgaaggaggtacgttcggggaccgtaacgggtaaaaccttcggacgtaacggtcgggggaaccgacggggtaaccctcggggtaccaccggttcccg

SEQ ID NO: 333443 - DNA, 687 bp, Homo sapiens
  misc_feature: GZ8MTXP02HFEDU.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcaccgtggagcagtctggacctgaggtgaagagccgtggggcctcgagtgaaggtctccgtgcgaaggtcttcgtggaccttaacctacccttttaccaccttagtggtcgtacaacgtgggtcgcgacgacggccccgtggacgagggtcttggaggtggagtgggatggatcgagcgtacttacgaagtacgggaaactaacgaaaactagtaccgacaacgtacggtaccgttaccgaaggggacacggtacgtaccaaacccgtaacttaacccaacgaacgaaccaacgactacccgaacgacgaccaacgacgacctaacgacgtacggaccgtaggaacggacgtccgtaggtagttacgttacggaaccgacgacggtacctaagttacttacgttacgtgtacgacggagtaggtacgttacggggaccgtaacggtaaaccgttcggaaccgttaacgggtacgggaccgtacggggtaccgtcggtaccgtaccggtcccg

SEQ ID NO: 333444 - DNA, 627 bp, Homo sapiens
  misc_feature: GZ8MTXP02GT59G.4.23.C01.1.454.CMB.2.raw
  modified_base (218)..(218): a, c, t, g, unknown or other
  misc_feature (218)..(218): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctnagtgaaggtctcctgcaaggcttctggctacacctttaccacctatggtgtcaactgggtgcgacacggcccctggacaagggcttgagtggagtgggatggatcgagcgtacttacaagtcggggaaacaacgaaaactatacggacaacgaacggaccgtttccgaaggggcacggaacgttccaacccgtaattaaccccaacgaaacggaaccaaccgactacccgaaccggaagacccaacaacggaccctaacacgtacggaccgtcgaaggacgccgtagacgtatttacggacgtacgacggaccaagtacttactacgtgtagacgagagtacgttggggaccgaacggtaactcgacgttaacggcggggacgaacgggacctcggaccacggttcccg

SEQ ID NO: 333445 - DNA, 555 bp, Homo sapiens
  misc_feature: GZ8MTXP02IIGHE.4.23.C01.1.454.CMB.2.raw
  modified_base (476)..(476): a, c, t, g, unknown or other
  misc_feature (476)..(476): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaggtctcctgcaaggcttctggctacacctttaccacctatggtgtcaactggtgcgacaggctcctggacaagggctgagtggatggatggatcagcgcttacaagtggggaacaacaaactatagcacagacgttccagggcagagtcaccattaccacacgacacataccacgagcacacgacctacaactggacctaggacggagcccgttgagagtttgaaccgacacggccaatactattactgtacgngagagtagttcgggaccgaaacggtaaccttacgaacgtacgtacggggaccgacggggaaccctcggtactaccccgg

SEQ ID NO: 333446 - DNA, 696 bp, Homo sapiens
  misc_feature: GZ8MTXP02GNKZN.4.23.C01.1.454.CMB.2.raw
  modified_base (268)..(268): a, c, t, g, unknown or other
  misc_feature (268)..(268): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccactatggtntcaacgtgggtgcgacacggcccctggacagggctgagtggagtgggatggatcgagcgactttaacgaagtgggaaacaacgtaaaactatacggacaacgaggacgtttaccgaaggggcacggacgtaccaaacctaacttaccgaaacacgaaccaacactacccaacggaacgaccaacacgacccttaacacgttacggaccgaggaagggacgtaccgttaggaagggtactttacggaaccggaaccgaaccgggtaccaaagtttaacgtatttaaacgtggttacgaacggaggtaaaggtaggttaccgggggaaccgtaaaaccgggggtaaaaccttcggtaaccgttaacggggtaaccgggggacccggtaaacggggtaaacccggtcggttaacccgcccggttaaccccg

SEQ ID NO: 333447 - DNA, 587 bp, Homo sapiens
  misc_feature: GZ8MTXP02JF636.4.23.C01.1.454.CMB.2.raw
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (398)..(398): a, c, t, g, unknown or other
  misc_feature (398)..(398): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtgggtgcgacgacggcccctggacaagggcttgagtggatggganggatcagcgnttacaagtgggaaacacgaaactatcgacacgagacgtccgagggcaggactcaccactacacagacacnctaccacgagcaacacgaccacactcgggacctaggaaggacgaccgtgagtatttagaaccgacgacggacctatacgttattacgtagtgacggagtagtacgttcgggaccggaacggtaaacccgttaggaccgtaacggtcggggaaccgacgggtaacccgtacggtaccgacccggttaccg

SEQ ID NO: 333448 - DNA, 644 bp, Homo sapiens
  misc_feature: GZ8MTXP02G49PY.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacagggcttgagtggatgggatggatcgagcgcttacaagtgggaaacacaaactatgacacagacgttccgagggcagacgtcaccataccacagacacataccacgacgacacacgacctacagtacggaccctggaacgggacgccgtagaacgtagtttacgggaaccgaaccgaaccgggaccctaaagttaacttaatttaacctaggttacggtacggaaggtaaggtacggtttacgggggacccggtaaccgggtaaaacccgtttcggaaaccgttaaccggtacgggggaacccgtaacgggggtaaccccgttacgggtacccgtacccggtttacccg

SEQ ID NO: 333449 - DNA, 673 bp, Homo sapiens
  misc_feature: GZ8MTXP02I953E.4.23.C01.1.454.CMB.2.raw
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagccgtggggcctcagtgaaggtctcctgcaaggcttcgnggctacacctttaccacctatggtgtcaacgtggngcgacacggcccctggacgagggctaggagtggagtgggatggatcgagcgacttacaagtacgggaacaactaaaacgtatacgacaacgtagtaccgttaccgagggcagtacgtaccaccgacttaacccacagaaccacactaccgaacgacgacaacgacgaccctaacgacgtacggaccgtaggaaacgggacgtaccgtaggtagttaacgtttacggaaccgaacgaccggtacctaagttaacttacgttaacgttagtacggacggtaagtaggtaacggttacgggaacccgggtaaaccggtaaaccggttacggtaaccgtaacgggtaccgggacccggtaaccgggtacccggttccggtacccgttaccgtcccg

SEQ ID NO: 333450 - DNA, 712 bp, Homo sapiens
  misc_feature: GZ8MTXP02GWEOJ.4.23.C01.1.454.CMB.2.raw
  modified_base (281)..(281): a, c, t, g, unknown or other
  misc_feature (281)..(281): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctactacctttaccacctatggtgtcaacgtgggtncgacacggcccctggacaagggcttggagtggagtgggatggatcgagtcgtacttaacgaagtagggaaaacctaacgaaaactagtaccgaccaacgtaagtaccggttcccgaaggggacacggggtaactacgaaccgtaacttaacccaaacgaacgaaccaaccaactacccgaacgacgacaaacccgacaccctaacgaacgttacgggaaccctaggaaacggggacgtaccgttaggaagtacgtttaacgggaaccgtaacccgaacgggtacctaattaaagttactttaacgtagttacgtacgaaggtaggtaaacggttcggggaaccgtaaaccgggttaaaccttaggaaccgtaacggttacggggaccggtaaaccggggtacccgtacggtacccgacccggtttaacccg

SEQ ID NO: 333451 - DNA, 661 bp, Homo sapiens
  misc_feature: GZ8MTXP02JWH1L.4.23.C01.1.454.CMB.2.raw
  modified_base (281)..(281): a, c, t, g, unknown or other
  misc_feature (281)..(281): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctactacctttaccactatggtgtcaacgtgggtncgacgacggcccctggacgagggcttgagtggagtgggatgggatcgagcgtacttacgaagttaggaaacaactaaactatccgacacgacgtaccgttccgaggggacagacgtaccaacccgtattaacccaacgacgaaccaacactacccgaacgacgaccaccgacgaccctacgacgtacggaccgtaggaacggacgaccgtaggtaacgtacgtttacggaacgaccgaacggtaccctaagtaacttaacgttacgtcgtacggacgaaggaggtacggttacggggaccggtaaaccggtaaccgttacggtacgtaacgggtcggggaccgtacggggtacccgtacgggtaccgtacccgttacccg

SEQ ID NO: 333452 - DNA, 614 bp, Homo sapiens
  misc_feature: GZ8MTXP02F92N3.4.23.C01.1.454.CMB.2.raw
  modified_base (373)..(373): a, c, t, g, unknown or other
  misc_feature (373)..(373): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatggggatggatcagcgacttacaagtgggaaacacaaactatcgacacagacgttcagggcngagtcacattaccacagacacatccacgagcacagacctacacgtcggacctggaacggagccgtaggagtagtttacggaaccgaacgaccgggaccaattaacttaacttaaacgtggttaggacggaggaaggtaacggtttacggggaccggtaaaccgggtaaaaccgttcgtaaccgtaaccggtcgggggacccgaacggggtaaacccgtcgggtacccgtaaccggttcccg

SEQ ID NO: 333453 - DNA, 647 bp, Homo sapiens
  misc_feature: GZ8MTXP02IAFBB.4.23.C01.1.454.CMB.2.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (398)..(398): a, c, t, g, unknown or other
  misc_feature (398)..(398): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtcnctgcaaggcttcnggctactacctttaccactatggtntacaacgtgggtncgacaggcccctggacaagggcttgagtggagtggatggatcaggcgtattaacgaagtgggaaacaacaaactatcgacacagacgttcagggcagtagtacacctataacccaanacacactacacacgacacacacgacctacgacgtacggacgtaggaggtacgacgtagtaagtagttacggaaccgacgaacggtactaagtttaaagttaacttacgtaggaacggtacgaaggtaggtaacggttaccgggggaaacccggtaaaaccggttaaaaccgttaacggtaaccggtaaccgggtaccggggaacccggtaaaccggggtaacccgttcggtaacccgtaacccgtcccg

SEQ ID NO: 333454 - DNA, 636 bp, Homo sapiens
  misc_feature: GZ8MTXP02IAXB8.4.23.C01.1.454.CMB.2.raw
  modified_base (242)..(242): a, c, t, g, unknown or other
  misc_feature (242)..(242): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttntggctacacctttaccacctatggtgtcaacgtggtgcgacacggcccctggacagggcttgagtggagtgggatggatcgagcgtacttaacgaagtgggaaaccacaaaactatacgacaacaggtaccgttccgaaggggcaggacgtccaacctaacttacccaacgagaaccaacactacccaacgacgacaaccagtaccctaacagtcggacctcggaaggacgtaccgtgtagtaacgtttaggaaccgacgaccgggacctaataattattactggtacgacggtaaggaggtacgttcggggacccgtaacgggtaaaaccttggaaccgtaacggtcgggggacccgtaacggggtaacccgtcgggttaccacccggttccc

SEQ ID NO: 333455 - DNA, 645 bp, Homo sapiens
  misc_feature: GZ8MTXP02HC7BN.4.23.C01.1.454.CMB.2.raw
  modified_base (351)..(351): a, c, t, g, unknown or other
  misc_feature (351)..(351): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgcttacaagtgggaaacacaaaactntcgacacagaccgttccagggccagagtcaccgattacccacagacacatccacgagcacacgcctacagtacgacctggaaggacgaccgtggtagtagtttacgggaccgtaaccgaccgggtaccctaagttaacttaacgtttacgtaggttacggtacggaaggaaggtacggtttacgggggacccggtaaccgggtaaaacccgtttacggaaccgttaaccggtacgggggaacccggtacgggggtaaaccccgttcggggtaccgtaacccgggtttacccccg

SEQ ID NO: 333456 - DNA, 561 bp, Homo sapiens
  misc_feature: GZ8MTXP02J133R.4.23.C01.1.454.CMB.2.raw
  modified_base (243)..(243): a, c, t, g, unknown or other
  misc_feature (243)..(243): n is a, c, g, or t
  modified_base (399)..(399): a, c, t, g, unknown or other
  misc_feature (399)..(399): n is a, c, g, or t
  modified_base (489)..(489): a, c, t, g, unknown or other
  misc_feature (489)..(489): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttcnggctacacctttaccacctatggtgtcaacgtggtgcgacaggccccctggacaagggcttgacgtggagtgggatggatcgagcgacttacgaatgggaaacacaaactatcgcacagacgttccaggcagagtcaccattaccacagacactanccacgacgacacacgcctacatacggacctggacggagcctaggagtattcggaacgacacggaccaatatattactgtgaccgagacgngttacggccgaacggtaaccctagtactaacgtcggggaccgacgggtaacccgcggtaccgacggttcccg

SEQ ID NO: 333457 - DNA, 593 bp, Homo sapiens
  misc_feature: GZ8MTXP02GXH6N.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggctgagtggatgggatggatcagcgcttacaatgggaacacgaaactatgcacagacgttcaggcagagtcaccgattaccacagaccacataccacgagcacacgacctacatacggaccctgaggacgaccgtggacgtatttagacgacgacgggaccatactattacgtgtcgtacgagagtacgttcggggaccggtaaccgggtaaaaccgttcggaaccgtaacggttacgggggtaacccgaacgggggtaaaccccgttcggggtacccgtaaccggtttccccg

SEQ ID NO: 333458 - DNA, 641 bp, Homo sapiens
  misc_feature: GZ8MTXP02GLTIQ.4.23.C01.1.454.CMB.2.raw
  modified_base (284)..(284): a, c, t, g, unknown or other
  misc_feature (284)..(284): n is a, c, g, or t
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctccgtgcaaggcttcgtggcctacacctttaccacctatggtgtcgaacgtgggtncgacacggccccctggacagggcttaggaggtggatgggatggatcgagcgcttacgaagtgggaaacacaaactatcgacacagacgttcgaggacngagtcaccataccanagacacatccacgagacaacacgaccctaacacgtacgggaccctaggaacggacgtaccgtagaagtacgtttacggaaccgaccgaaccgggacctaagttaattaacgtttacgtaggttagaccggtaaggtaaggtacggttacgggggaccggaaaccggggtaaaacccgttggaaaccgtaacggtacgggggacccgtaccggggtaacccgtcggtacccgtaaccggttcccg

SEQ ID NO: 333459 - DNA, 626 bp, Homo sapiens
  misc_feature: GZ8MTXP02FS465.4.23.C01.1.454.CMB.2.raw
  modified_base (267)..(267): a, c, t, g, unknown or other
  misc_feature (267)..(267): n is a, c, g, or t
  modified_base (463)..(463): a, c, t, g, unknown or other
  misc_feature (463)..(463): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtntcaacgtggtgcgacaggcccctggacaagggcttgagtggagtgggatggatcgaggcgacttaacgaagtagggaaaccaacaaaactatacgacaacgacgacgttaccgaagggcaggacgtaccaacgtacttaccaacgagaaccacacacccaacgacgacaacacgaccctaacacgtacgaacccgnggaaggacgaccgtaggtaagtacgtttacggaaccgaaccgacggaccaattaatacttaacgtgtacgacgagagtacggttacgggaccgtaacggtaaaaccgttgaacgtaacggtcggggaccgaacggggtaccctacggtaccgtaccgtacccg

SEQ ID NO: 333460 - DNA, 669 bp, Homo sapiens
  misc_feature: GZ8MTXP02GIIS2.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactggtgcgacaggcccctggacaagggcttgagtggatgggatggatcgagcgcttacaagtgggaaacacaaactatcgacacagacgttccgaaggggcaggacgtaccgaacctaacttaacccaacgaacgaaccaacactacccaacgacgacaacaacgccctaacagtcgaacccgtgaagggacgccgtaggacgtagtttacgaaccgacgaacggacctaagttaacttaacttaacgtggttacggacggtaagggaaggtaacggttacgggggaacccggtaaacgggtaaaaacccgtttcggaaaccgttaaccggtacgggggaacccgtaaaccgggggtaaaccccgttacggggtaccccgtaacccgggtttccccg

SEQ ID NO: 333461 - DNA, 598 bp, Homo sapiens
  misc_feature: GZ8MTXP02FFW48.4.23.C01.1.454.CMB.2.raw
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagcctggggcctgagtgaaggtctctgcaggcttngctacnccttacnctanggtntcactgggtncgacacggcccctggacgaagggcttgagtggagtgggatggatcgagcgacttaacgaagtacgggaaacaacaaactagtcgacacgacggtaccgttaccgaggggcaggacgtaccaaccgtacttaaccacaacgaccaacactacccaacgacgcaacacgaccctaacacgtacggacctaggaggacgccgtagagtatttacgggaacgaccgaccggacctaattaatattacgtgtgacgagaggtacgtcggggaccgaacggtaacctgacgtaacggtcggggaccgacggggaccgtacggacctacggtcc

SEQ ID NO: 333462 - DNA, 551 bp, Homo sapiens
  misc_feature: GZ8MTXP02FJOJM.4.23.C01.1.454.CMB.2.raw
  modified_base (342)..(342): a, c, t, g, unknown or other
  misc_feature (342)..(342): n is a, c, g, or t
  modified_base (368)..(368): a, c, t, g, unknown or other
  misc_feature (368)..(368): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactggtgcgacaggcccctggacaagggcttgagtggatgggatggatcgagcgcttacaatgggaacanaaactatcgcacagacgttcagggcntagcacattaccacagacacactaccacgagcaacacgcctaacacgtggacctgacggagcctagagtatttaggacgaacgacggaccaatactatactgtgacgagagagttagggaccgaacggaaaaccttgaactaacgtcggggaccgacgggaacccgtggtaccaccggtaccc

SEQ ID NO: 333463 - DNA, 695 bp, Homo sapiens
  misc_feature: GZ8MTXP02G5BFN.4.23.C01.1.454.CMB.2.raw
  modified_base (350)..(350): a, c, t, g, unknown or other
  misc_feature (350)..(350): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttacaacctatggtgtcaactgggtgcgacaggcccctggacaagggcttgagtggatgggatggatcgagcgcttacaatgggaaacacaaactancgcacagacgtcagggcagacgtcaccattaccacagacacatacccacgagccaacacgaccctaacacgttacggacccttaggaaacgggacgacccgtaggaacgtacgttttacgggaaccgtaaccgaccgggtaccctaaagttaagttaactttaaccgtaggttacggacgtaaacgggtaggtaacggtttaccgggggaccccggtaaaccgggggtaaaaccctttacggggtaaacccgttaacccggggttacggggggaacccccggttaaaacgggggtaaaccccccggttacggggttacccccggtaaccccggggtttacccccg

SEQ ID NO: 333464 - DNA, 550 bp, Homo sapiens
  misc_feature: GZ8MTXP02HSLEO.4.23.C01.1.454.CMB.2.raw
  modified_base (244)..(244): a, c, t, g, unknown or other
  misc_feature (244)..(244): n is a, c, g, or t
  modified_base (376)..(376): a, c, t, g, unknown or other
  misc_feature (376)..(376): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctctgaccaggcttcnggctacacctttaccacctatggtgtcaactgggtgcgacaggcccctggacaagggcttgagtggagtgggatgggatcgagcgcttacaagtgggaaacacgaaactatcgacacagacgttcgagggcngagtcaccattaccacagacacatccacgagcacacgcctacatcgggacctggaggacgccgtaggacgtagtttcggacgacgaccggccaagtatattactgtgcgagagagttgggaccgacggaactgactaacggtcggggccgacgggacccgtcggtccacggtcc

SEQ ID NO: 333465 - DNA, 639 bp, Homo sapiens
  misc_feature: GZ8MTXP02G4RN9.4.23.C01.1.454.CMB.2.raw
  modified_base (359)..(359): a, c, t, g, unknown or other
  misc_feature (359)..(359): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaacgtgggtgcgacgacggccccgtaggacaagggcttggaggtggagtgggatggatcgagcgcttacaagtgggaaacacaaactatnacacacgacgttcgaggcagagtacaccgactaccgacaacgacacactaccaacgacgacacacgaccctaacacgtcggaccgtacggacgggacgtcccgtaggacgtacgtttacgggaaaccgtaacgaccgggaccgtagttaaacttacgttaaccgtgttacggacgtaaggtaggtacggtttacggggaccggtaacggtaaaccgttgaaccgtaacggttacgggggacccgtacggggtaaccgtcgggtaccgtacccggttcccg

SEQ ID NO: 333466 - DNA, 679 bp, Homo sapiens
  misc_feature: GZ8MTXP02HZKOV.4.23.C01.1.454.CMB.2.raw
  modified_base (242)..(242): a, c, t, g, unknown or other
  misc_feature (242)..(242): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttcnggctactacctttaccactatggtgtcaacgtgggtgcgacacggcccctggacaagggcttgagtggagtgggatggatcgagcgtacttaacaagtaggggaaacaacgaaaactatacgacaacgagaccgttaccgaaggggcagacgtaccaacccgaacttaacccacaaacgaacctacactacccgaacgaacgaccaacacgaccctaacgacgtacggaccgtaggaaaggcgaccgtaggaacgtacgtttacgaaccgtaacgaccgggacctaacgtaacgttaacgttaaccgttaggtacggtacggtaggaaggtacggttacgggggaaccggtaaaccgggtaaaccgttacggaaaccgttaaccggtacggggacccggtaacggggtaaacccgtcggtaccgtacccggttcccg

SEQ ID NO: 333467 - DNA, 607 bp, Homo sapiens
  misc_feature: GZ8MTXP02GCURV.4.23.C01.1.454.CMB.2.raw
  modified_base (268)..(268): a, c, t, g, unknown or other
  misc_feature (268)..(268): n is a, c, g, or t
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaacgtgggtgcgacaggctccgtggacaagggcttgagtggagtgggatggatcgagcgtacttacaagtgggaaacacgaaactatgacacagtacgttaccgagggcagagtcaccatacanacgacacacaccacgancacacgacctacacgtacggaccgtaggaacggacgaccgtagacgtagtttcggaaccgacgaccggtacctattaattacgttacgtcgtaggacggagtaacggtacggttacgggacccggtaaacgtaaccgttacggaaccgtacggtacggggaccgtaaccgggacccgttacggtaccgtaccccgg

SEQ ID NO: 333468 - DNA, 532 bp, Homo sapiens
  misc_feature: GZ8MTXP02GP41S.4.23.C01.1.454.CMB.2.raw
  modified_base (366)..(366): a, c, t, g, unknown or other
  misc_feature (366)..(366): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaaacacaaactatgcacagacgttcaggcngagtcaccattaccacagacacataccacgacgcacagcctacatggacctgacggagcctgagatttagacgacacggccatatattactgtgcgagagacgttgggaccgacggaaaccttgaacctaacgtcggggaccacggggaccctggtccgaccgtcc

SEQ ID NO: 333469 - DNA, 554 bp, Homo sapiens
  misc_feature: GZ8MTXP02IBBWI.4.23.C01.1.454.CMB.2.raw
  modified_base (353)..(353): a, c, t, g, unknown or other
  misc_feature (353)..(353): n is a, c, g, or t
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (491)..(491): a, c, t, g, unknown or other
  misc_feature (491)..(491): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgagtgaagaagcctgggcctcagtgaaggtctcctgcaaggcttctggctacacctttaccacctatggtgtcactggtgcgacaggcccctggacaagggcttggagtggagtgggatggatcgagcgacttacaagtgggaaaacaacgtaaatanacgacaacgacgtacgtacggaggacagacgtacactactacacganacactacacagcacanacgacanagtacgacgagacgacgtcgagtagttagtacgaacgacgacgactatattactagtagtcgacgagngtacgtacggacgtaacgtacgtgacgtaacggcggacgacggtaccgtcgtaccgtacgtcc

SEQ ID NO: 333470 - DNA, 565 bp, Homo sapiens
  misc_feature: GZ8MTXP02F5QC9.4.23.C01.1.454.CMB.2.raw
  modified_base (386)..(386): a, c, t, g, unknown or other
  misc_feature (386)..(386): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgcttacaagtgggaaacacaaactatcgacacagacgttcagggcagagtcaccataccanagacacatcccacgagcacacgcctaacatcggacctgaggagccgtagagtatttaggacgacgacggaccagtatattactgtgacgagagacgttcgggaccgtacggaaaccgttggaacgtaacggtacgggggaccgaacggggtacccgtacggtaccgtaccggttacccg

SEQ ID NO: 333471 - DNA, 599 bp, Homo sapiens
  misc_feature: GZ8MTXP02GA1GL.4.23.C01.1.454.CMB.2.raw
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacaggcccctggacaagggcttggagtggatgggatggatcagcgcttacaagtagggaaacacaaactatcgcacagacgttcgaggcagagtcacattaccacagacacatccgacgagcacacgcctacactggacctggacggacgccgtaggagtagtttacggaaccgaaccgaccgggacctaattacttaagtttaacctggttagacggagtacggagttcgggggacccggaaccggtaaaccgttcgaaccgtaacgggtcggggaccgaacggggtaccccgtacgggtacccaccggttcccg

SEQ ID NO: 333472 - DNA, 547 bp, Homo sapiens
  misc_feature: GZ8MTXP02FNQER.4.23.C01.1.454.CMB.2.raw
  modified_base (218)..(218): a, c, t, g, unknown or other
  misc_feature (218)..(218): n is a, c, g, or t
  modified_base (278)..(278): a, c, t, g, unknown or other
  misc_feature (278)..(278): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctnagtgaaggtctcctgcaaggcttctggctacacctttacacctatggtgtcaactgggtncgacaggcccctggacaagggcttgagtgagtgggatggatcagcgcttacaatgggaacanaaactatcgcacagacgttcaggcngagtcaccgataccacagacaacataccacgagcacacgacctacacgtgacctgacggagccgtagagtattgaacgacacggacctatatatactgtgcgagatagttgggaccgacgggtaaaaccttgaactaacggtacggggaccacggggacccgtacggtaccgaccggttccg

SEQ ID NO: 333473 - DNA, 755 bp, Homo sapiens
  misc_feature: GZ8MTXP02GZBYC.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttcgtggctacacctttaccacctatggtgtcaactgggtgcgacacggcccctggacgaagggcttggagtggagtgggatggatcgaggcgactttaacgaagtacggggaaacaacgaaaactagtcgaccaacgtacgaaccgtttccgaaggggtcaggtacgtaccgaacctaacttacccaacgaacgaaccaacaactacccaacgacgaccaacgacgaccctaacgagtacggacccgtaggaaacgggacgacccgtaggtaacgtacgtttacggaaccggaaaccgaacccgggaccgtaaacgttaacttaaacgtttaacccgtaggttacgggaccggaacgggttaaggttaacgggtttaccgggggaaccccggtaaaaccggggtaaaaccccgtttacggtaacccggttaaccggggttaccgggggaccccgtaaaaccgggggtaacccccgttacggggttaaccccctaacccccggggtttaacccccg

SEQ ID NO: 333474 - DNA, 647 bp, Homo sapiens
  misc_feature: GZ8MTXP02HIY32.4.23.C01.1.454.CMB.2.raw
  modified_base (268)..(268): a, c, t, g, unknown or other
  misc_feature (268)..(268): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaactgggtgcgacacggcccctggacagggctgagtggatgggatggatcgagcgacttacaagtgggaaacacaaactntcgcacagacttcgaggcatagtcacactaccanagacacactaccacgagacacgaacgcctaacagtacggacctgaaggacgaccgtgaagtatttacggaaccgaacgaccggacctaagttaacttacgttaaccgtgtacgacggtaaggtacggtaaggtttcggggaacccggtaaaccggggttaaaccgtttacgggaaaccgttaaccgggttacgggggaaccccggttaaaccgggggaaacccccggttacggggtaaccccgttaaccccgggtttaccccg

SEQ ID NO: 333475 - DNA, 539 bp, Homo sapiens
  misc_feature: GZ8MTXP02FFQZZ.4.23.C01.1.454.CMB.2.raw
  modified_base (218)..(218): a, c, t, g, unknown or other
  misc_feature (218)..(218): n is a, c, g, or t
  modified_base (341)..(341): a, c, t, g, unknown or other
  misc_feature (341)..(341): n is a, c, g, or t
  modified_base (384)..(384): a, c, t, g, unknown or other
  misc_feature (384)..(384): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctnagtgaaggtctcctgcaaggcttctggctacacctttaccacctatggtgtcaactgggtgcgacaggcccctggacaagggcttgagtggatgggatggatcagcgcttacaatgggaacanaaactatcgcacagacgttccagggcagacgtcacattaccanagacacatcccacgagcacagcctacatggacctgaggagcctgagattgacgacacggccatatattactgtgcgagagtagttcgggaccgaacggtaaaccttggaaccgtaacgtcggggaccgacggggaccctcggtaccaccggtccg

SEQ ID NO: 333476 - DNA, 739 bp, Homo sapiens
  misc_feature: GZ8MTXP02HKBAH.4.23.C01.1.454.CMB.2.raw
  modified_base (364)..(364): a, c, t, g, unknown or other
  misc_feature (364)..(364): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctacacctttaccacctatggtgtcaacgtgggtgcgtacacggcccctggacaagggtcttgagtggagtggggatggatcgagcgacttaacgaagtgggaaaccactaaaacgtntacgaccacgagtaccgttcgaggggcagggacgtaccgaacctaacgttacccaaacgaacgaacccaacctaactacccccgaacggtaacgacccaaaccgacggtaccccttaaacgaacggtttaccggggaaacccgttaggggaaaccggggtaaccggtacccggttaagggtaaacgttacgtttacggggaaacccgtaacccggaacgggtaccctaaagtttaacttacgttaacgtcgggtacgaccggtaaggtacggtacggttaccgggggacccgaaaccgggttaaacccgtttgaacccgttaacggtcggggacccgtaacgggggaacccttcgggaccgttaacccggttccc

SEQ ID NO: 333477 - DNA, 629 bp, Homo sapiens
  misc_feature: GZ8MTXP02GOLM0.4.23.C01.1.454.CMB.2.raw
  modified_base (268)..(268): a, c, t, g, unknown or other
  misc_feature (268)..(268): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtntcaactggtgcgacaggcccctggacaagggcttggagtgagtgggatggatcgagcgcttacaagtgggaacacaaactatcgcacgagacgttcgaggcagagtcaccataccacacgacacatacccagacgacaccgacgacctacagtcggaccgtggaacgacggccgttaggaagtacgtttaggaaccggtaacaccgggacctaattaacttaagtttaccgtaggttacggaaccggtagtaaaggtacggtttaacggggacccgtaacggggtaaaccgtaagtaccgtaacggttacgggggaccgtaaacggggtaacccgtcgggtaaccgacccggtttaacccg

SEQ ID NO: 333478 - DNA, 720 bp, Homo sapiens
  misc_feature: GZ8MTXP02JRJ74.4.23.C01.1.454.CMB.2.raw
  modified_base (469)..(469): a, c, t, g, unknown or other
  misc_feature (469)..(469): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcagtgaaggtctcctgcaaggcttctggctactaccctttaccacctatggtgtcaacgtgggtgcgacgacggcccctggacgagggcttggagtggagtgggatggatcgaggcgactttaacgaagtagggaaaccaacgaaactataccgacaacgtacggaccgttccgaaggggcacggtacgtaccaaccctaacgttaacccaacgaacgaacccaaccactacccgaacgaacgacaaccganaccctaacgacgtacgggacccgtagggaacggacgaccgtacggtaagtacgtttacggaaccgtaaccgaacccgggtacctaaagttaacttaacgtttaacgttcggtaacggtacggaaggtaagggtacggtttaccgggggaaccggtaaaccgggtaaaccgtttacggaaccggtttaaccgggtacgggggacccggtaacggggtaaccccgttcggggtaaccctaccggtttaccccg

SEQ ID NO: 333479 - DNA, 699 bp, Homo sapiens
  misc_feature: GZ8MTXP02IGCM5.4.23.C01.1.454.CMB.2.raw
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcagtgaaggtctcctgcaaggcttnggctactacctttaccacctatggtntcactggtgcgacacggcccctggacaagggcttggagtggagtgggatggatcgagcgacttacaagtgggaaacactaaaactatacgacacgaacgtacgttaccgaaggggctagggacgttacaacccgtaacttaccccgaacgtaacgaaccaactacacccgaacgaacgaccaacacgaccttaacgacgtacggacccgtaggaacggacgcccgtaggtaagttacgtttacgggaaccgaacccgaaccgggtacctaagttaacgttaactttaaccgtggtttacggaacggtaaggtacggttacggttacgggggaacccggtaaaccgggtaaaaccgtttcgaaaccgttaacggggtaccggggtaccggaaaccggggtaacccgttcgggtacccgtaccgtttacccg

SEQ ID NO: 333480 - DNA, 566 bp, Homo sapiens
  misc_feature: GZ8MTXP02GC0G1.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaatgggtgcgacaggcccctggacaagggcttgagtggatgggatggatcagcgcttacaagtgggaaacacgaaactatacgcacagacgttcagggcagagtcaccattaccacagacacatccacgagcacagcctacatgacctgaggagcctgacgatttgaacgtaccgacggaccataatacttaacgtgtgacgaaggagattcggggaccgaacgggaaacccttggaacctaacggttacggggaccgacggggaacccgtacggggtacccaccgggtttacccg

SEQ ID NO: 333481 - DNA, 607 bp, Homo sapiens
  misc_feature: GZ8MTXP02GXCDR.4.23.C01.1.454.CMB.2.raw
  modified_base (239)..(239): a, c, t, g, unknown or other
  misc_feature (239)..(239): n is a, c, g, or t
  modified_base (391)..(391): a, c, t, g, unknown or other
  misc_feature (391)..(391): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagaagcctgggcctcagtgaagtctctgcagcttcnggctacacctttacacctatggtgtcaactggtgcgacacggcccctggacaagggcttgagtggagtgggatggatcgagcgacttaacgaagtagggaaacacaaaactatcgacacagacgttacgagggcagagtacacgactaccanacgacacatacccagacgcaacacgacctaacagtcggaaccgtggaaggacgccgtaaggtagtagtttacgggaaccgaaccgaaccggaccctaaatacttaattaccgttaggacgtacggagtagacggttacggggaccgaacggtaaaaccttggaactaacggtacggggacccgacgggaacccgtcggttaccgacccgtttcccg

SEQ ID NO: 333482 - DNA, 648 bp, Homo sapiens
  misc_feature: GZ8MTXP02G1LFS.4.23.C01.1.454.CMB.2.raw
  modified_base (241)..(241): a, c, t, g, unknown or other
  misc_feature (241)..(241): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaggcttcnggctacacctttaccaccttatggtgtcaacgtgggtcgcgacacggccccctggaccaagggcttgaggtggagtgggatggatcgagcgacttaacaagtagggaaacaacaaaacttactcgaccacgtaagaccggttcgaagggcaggacgttaccaaccgaacttaacccaacgtacgacacactaccacgacgacacacgacctaacacgtacgaccgtagacggacgccgtagagtagttacgacgtaccgacggaccagtacttaattacgtaggtcggacgtaggagtacggttacggggaccggtaaccgggtaaaaccgttcggaaccgttaacgggttcgggggaacccggtaaccggggtacccggtaccgggtaccgtacccggtttacccg

SEQ ID NO: 333483 - DNA, 615 bp, Homo sapiens
  misc_feature: GZ8MTXP02IBK8Q.4.23.C01.1.454.CMB.2.raw
  modified_base (272)..(272): a, c, t, g, unknown or other
  misc_feature (272)..(272): n is a, c, g, or t
  modified_base (365)..(365): a, c, t, g, unknown or other
  misc_feature (365)..(365): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgagtgaagagccgtgggcctcagtgaaggtctcctgacaaggtcttcgtggctactaccctttaccacctagtggtntcacgtggtgcgacacggcccctggacgaaggcttggagtggagtgggatggatcgagcgtacttaacaagtacgggaaacaaactaaactanacgacaacgtacgacgttacgagggacagacgtcaaaccgtattacccaacgactacaaccactaccacgacgacacgacacctacacgtcggacctaggacggtgaccgtgtaagttagttacggaacgtaccgaacggactataacgtttaactacgttgacggacgacggtaggtacgttacgggaccgtaacggtaacttcgacgtaacggacggaccggacggtaccgtcggtacctaccgtccg

SEQ ID NO: 333484 - DNA, 594 bp, Homo sapiens
  misc_feature: GZ8MTXP02IKFTA.4.23.C01.1.454.CMB.2.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagctgggctnagtgaggtctctgcaggcttntgctacaccttaccactatggtgtcaacgtgggtgcgacgacggcccctggacaagggtctggagtggagtgggatgggatcgagcgtacttanaagtgggaaacacaaatntacgacacgagtacgttcgaacgggtcagtacgtaccaacctacttaacccacaaacgaccaactaacacccaacgacggacaaccgacgaccctaacgaacgtacggaccctaggacggaacgccgtagaacgtacgtttaggaacgacgacggaccaatatacttacgtgtgacgagagacgttcgggacgacgtaactacgacgtaacggcgggtacgacggaccgtcggacgtaccgtacccg

SEQ ID NO: 333485 - DNA, 664 bp, Homo sapiens
  misc_feature: GZ8MTXP02I1URZ.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacaggcccctggacaagggcttgagtggatgggatggatcgagcgacttacaagtgggaaacacaaactatcgacacgagaccgttccaggggtccaggacgtccaaccacgttacccaacacgacaacgactacccaacgagaccaacacgaccctaacgatacgggaccctaggaagggacgtacccgtaggagtacgtttcggaaccgtaaccgacggacccaagttaacttactttaacgtgttacgacggtaggtaaggtacggtttacggggaacccggtaaaccgggtaaaaccctttcgggaacccgttaacggtaccgggggacccgtaaacgggggtaaccccgttacgggtacccgtaaccccgtttcccg

SEQ ID NO: 333486 - DNA, 643 bp, Homo sapiens
  misc_feature: GZ8MTXP02I2GOM.4.23.C01.1.454.CMB.2.raw
  modified_base (479)..(479): a, c, t, g, unknown or other
  misc_feature (479)..(479): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcgagtgaaggtctcctgcaaggcttctggctactacctttaccacctatggtgtcaacgtgggtgacgacacggcccctggacgaagggtcttggagtggagtgggatggatcgagcgtacttaacgaagtacgggaaactaacgaaaactatacgacctaacgacgtacgttccgacggggacacgggtacgtaccaacctacttaacccaacgaacgaccaacactcccgaacgacgacacacgacctacacgtcggaccnggaacggacgtccgtaggtaacgtacgtttacggaacgaccgaccggacctaatacttagttacgtgtagacgaggtagtacggttacgggaccgtaacggtaaccttacggaacgtaaccggtcggggaaccgtacgggaaccgtcggtacctaccggtaccc

SEQ ID NO: 333487 - DNA, 737 bp, Homo sapiens
  misc_feature: GZ8MTXP02HT691.4.23.C01.1.454.CMB.2.raw
  modified_base (242)..(242): a, c, t, g, unknown or other
  misc_feature (242)..(242): n is a, c, g, or t
  modified_base (321)..(321): a, c, t, g, unknown or other
  misc_feature (321)..(321): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtcgcccactcccaggttcacctggagcagtctggacctgaggtgaagagccgtgggcctcgagtgaagtctctgcaggcttcnggctactacctttaccacttatggtgtcaactgggtgcgacacggcccctggacgaaggcttgagtgagtggatggatnaggctcttaacgaagtagggaaacacaaaactagtacgacaacgtacgtaaccggtttcgacggggcacggtacgttaccaaacctaaccgtttaacccaacgaaacgtaaacccaaccttaaacgaccccgaacgaacggaccaaacccggtacgaaccccgttaactaacgtaccggggaccccttaggggaaacggcgtacccgttaggtagtaacgtttacgggaacggtaaacccgaaccgggaccctaaagttaaccgttaaatttaaccgtaggttaccggtacggaaggtaaaggtaacggtttcgggggaaacccgtaaccggggtaaacgttaccggtaacgtaaccggttcggggaacccggtacggggtaaacccgttaaccgggtccgttaacccgtccccgg

SEQ ID NO: 333488 - DNA, 591 bp, Homo sapiens
  misc_feature: GZ8MTXP02GYSFR.4.23.C01.1.454.CMB.2.raw
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctcagtgagtctctgcagcttngctacaccttacactatggtncactgggtncgacncggcccctaggacgaagggcttaggagtggagtgggatggatcgaggtcgacttaacgaagtagggaaacaacgaaactagtccgacacaggaccgttcgagggcagggactacaccataccananacacancacgagcacacncctanacgtgacctgagcgtccaggtagtagttacgacgaccgacggactaatatacgttacgtgtcggtacgtagaggtacggttaccgggaccggtaacggtaaaaccttcggaaccgtaacggtcggggtaaccgtaacccggggtaaccgtacggtacccgtaccggttcccg

SEQ ID NO: 333489 - DNA, 557 bp, Homo sapiens
  misc_feature: GZ8MTXP02GUO1J.4.23.C01.1.454.CMB.2.raw
  modified_base (393)..(393): a, c, t, g, unknown or other
  misc_feature (393)..(393): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacacggcccctggacaagggcttggagtggagtgggatggatcgagcgcttacgaatggggaaacacaaactatcgacacagacgttccagggcagagtacaccattaccanaagacacatccagacgcacacgcctaacatcggacctggaggacgaccgtgacgtatttggaacgacgacggaccaatactattactgtgacgagtagacgttgggaccgacggaaaccgttgactaacgtcggggacgacgggtacccgtggtaccacgttcc

SEQ ID NO: 333490 - DNA, 547 bp, Homo sapiens
  misc_feature: GZ8MTXP02FXAAV.4.23.C01.1.454.CMB.2.raw
  modified_base (430)..(430): a, c, t, g, unknown or other
  misc_feature (430)..(430): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacactttaccacctatggtgtcaactggtgcgacacggcccctggacaagggcttgagtggatgggatggatcagcgcttacagtagggaaacacgaaactatgacacagacgttccgaggcagacgtcacgataccacacgacaacactccgaacagacaacacgcccaacacgtacgaccngaggacgccgtagagattagacgacacggcataacgtattactgtcgacgagagcgtagggaccgacggaaacctgaactaacggtcgggaccgaacggaccctggtccacgtcccg

SEQ ID NO: 333491 - DNA, 625 bp, Homo sapiens
  misc_feature: GZ8MTXP02IQSUG.4.23.C01.1.454.CMB.2.raw
  modified_base (367)..(367): a, c, t, g, unknown or other
  misc_feature (367)..(367): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatcgcacagacgttccaggcngagtcaccattaccacagacacataccacgacgcaacacgccctaacatacgggaccctggaaggacgcccgtaggagtagtttaggaaccgaaccgaccgggaccaattaacgttaatttaacgtgttacggacggtagaacggtagtttacgggggacccggtaaccgggtaaaacccgtttcggaaaccgttaacggtaccgggggaccgtaacgggggtaaccccttacggggtacccgtaacccggtttcccg

SEQ ID NO: 333492 - DNA, 632 bp, Homo sapiens
  misc_feature: GZ8MTXP02H4VRG.4.23.C01.1.454.CMB.2.raw
  modified_base (464)..(464): a, c, t, g, unknown or other
  misc_feature (464)..(464): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctacacctttaccacctatggtgtcaacgtgggtgcgacacggccccctggaccgaagggcttggaggtggagtggggatggatcaggccgtacttacgaaagtgggaaacacaaactatcgacacaggtaccgttcgaagggcaggacgtacaacccaacttacccaacacgaacctacatcccaacgacgacaacacgacctaacactcggacccnggaacggacgccgtaggtagtacgtttcggaaccgacgaccggacctaagttaacttacgttacgtagtcgacgaggtagtaggttacgggacggtaccggtaaaccgttgaacgtaacggtacgggaccggtaacgggtacccgtacggtacccgtaaccgttcccg

SEQ ID NO: 333493 - DNA, 667 bp, Homo sapiens
  misc_feature: GZ8MTXP02I4VJ7.4.23.C01.1.454.CMB.2.raw
  modified_base (230)..(230): a, c, t, g, unknown or other
  misc_feature (230)..(230): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctcagtgaaggtctccngcaaggcttcgtggctactacctttaccacctatggtctctacgtgggtgcgacgacggcccctggacaagggtcttggagtggagtggagtggatcgagcgacttaacgaagtgggaaacaacgtaaactatcgacacgacgtaccgttcaggggacaggacgtacaacctactaaccaacacgacacactaccaacgacacacaacgccgaactacgtacgaccgtacgaggtacgacgtagtacgaagactttacgaaccggactaacgggtaccaacttaagtagtttaacgtaggtaggtacggtaacggtaacggggaaacgtttacgggggaacccgttacggggaaaaccccggttttaggaaccgggtaaacccttacggggggtacccctaagggggtaaaccccctcgggttaccgtaacccccgg

SEQ ID NO: 333494 - DNA, 632 bp, Homo sapiens
  misc_feature: GZ8MTXP02FT6UR.4.23.C01.1.454.CMB.2.raw
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccnctatggtntcaagtggtncgacacggcccnggacagggcttgagtggagtgggatggatcgagcgtacttaacaagtgggaaacaacaaactagtacgacacgaagaccgttacaagggcaggactacaacctactaacccaacagaaccaacactacccgaacgacgaccaaacacgaccctaacaagtacggacctgaagggactaccgagtagtaagttacggaaactaacccgacggacctaagttaattacttacgtagtacgacggtagtaaggtaggttaccggggaccgtaaaccgggtaaaactcggtaaaccgtaacggtacggggacctaacgggggaacccctgggaccctaaccggtccg

SEQ ID NO: 333495 - DNA, 671 bp, Homo sapiens
  misc_feature: GZ8MTXP02I1NH2.4.23.C01.1.454.CMB.2.raw
  modified_base (369)..(369): a, c, t, g, unknown or other
  misc_feature (369)..(369): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcgagtgaaggttctcctgcaaggcttcgtggctactacctttaccacctagtggtgtcaacgtgggtgcgacgacggccccgtggacgaagggtcttggagtggagtgggataggatcgagcgtacgttagaagtacggaaacacaaactntaccgacacgacgtacgttaccgacgggacaggacgtaccgaacctacgttaccaactacgacaactacaccgacgacgaccaactacgaccctacgacgtacggaccgtggaacggtacgtacctacggaggttacgttacgggaaccgtacgaacccggctaaacgttattacgttacgtagttcgacgaacggtagtaacggttaccggggaccgtaacggtaaacccgttggtaacccgtaacgggtacggggtaaccgtaccggggtaccctacgggttaccccgaacgtttccccg

SEQ ID NO: 333496 - DNA, 589 bp, Homo sapiens
  misc_feature: GZ8MTXP02IVI6M.4.23.C01.1.454.CMB.2.raw
  modified_base (394)..(394): a, c, t, g, unknown or other
  misc_feature (394)..(394): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcgagcgacttacgaatggggaaacacgaaaactatcgacacagacgttccaggggcaggagtcaccattaccanagacacatccacgagcaacagcctaacagtcggacctgaggaagccgtagagtatttggaacgacgacggactataatattacgtgtacgacgagacgtagttacggggaccgacgggtaaaaccttggaaccttaaccggtcgggggtacccaacgggggtaacccctacggggtaccgtaacccggtttcccg

SEQ ID NO: 333497 - DNA, 618 bp, Homo sapiens
  misc_feature: GZ8MTXP02FU67N.4.23.C01.1.454.CMB.2.raw
  modified_base (380)..(380): a, c, t, g, unknown or other
  misc_feature (380)..(380): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactccccaggttcacctggagcagtctggacctgaggtgaagagcctggggcctcagtgaaggtctcctgcaaggcttctggctacacctttaccaccttatggtgtcaacgtgggtgcgacacggcccctggacaagggcttggagtggagtgggatgggatcgagcgcttacgagtagggaaacaacgaaactatcgacacagtacgtcgaggcngagtcacactaccaacagacacatccgacgagacacagacctacatcggacctggaacggacgcccgtaggaagtacgtttacggaacgaaccgaccggacctaagttaacttaacgttaacgtgttaggaccgtaggaggtaacggttacgggaaccggaacgggttaaaaccgttgaaaccgttaacggtacgggggaccgaacgggtaccccgtcggtacccgtacggttacccg

SEQ ID NO: 333498 - DNA, 649 bp, Homo sapiens
  misc_feature: GZ8MTXP02I9Q17.4.23.C01.1.454.CMB.2.raw
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (394)..(394): a, c, t, g, unknown or other
  misc_feature (394)..(394): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacgaggtgcccactcccgaggttcacctggagcagtctggacctggaggtgaagagccgtgggcctgagtgaaggtctcctgacaggtcttctggccttactacctttaccacttagtggtgtcaagtgggtcncgacgcggccctgacgaggctgagtggagtgganggtntgagctactanaagtaggaaactanaaatncacatcgtacgtcgaggcaggctacaccactaaccganacgtacacactaccgacgacacgtaacagaccctaagacgtacgggaccttagggaccgacgtaccgtaggtagttaaacgttcgggaaaccgaacccggacccggtacgttaaactttaagtaaacgtttcgtaaacgcggtaaccgagtaaacgggtacggttccggaaaccggtaacggttaaaccttggaaaccgtcggggtacggggaccgtaccggggtttaccgacggttaacccgtcccggttaacc

SEQ ID NO: 333499 - DNA, 643 bp, Homo sapiens
  misc_feature: GZ8MTXP02FRB33.4.23.C01.1.454.CMB.2.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (611)..(611): a, c, t, g, unknown or other
  misc_feature (611)..(611): n is a, c, g, or t
tcagagcactgtagcacgaccggtgctcgatttagtacacgtgattagggattggggacccaaaaaaccacacccctccttgggcgaatcccctagatcacagctcctcaccatggactggacctggagcatccttttcttggtggcagcagcaacaggtgcccactcccaggttcacctggagcagtctggacctgaggtgaagagctgggcctnagtgaagtctcctgcaggcttntggctacaccttaccactatgtgtcaacgtggngcgacgacggcccgtaggacgagggtctggagtggagtgggatggatcgagcgacttacgaagtcggaaacaacaaactatacgacacgacggtacgttacgacgggtacgacggacgtaccgtaaacctaaccgttaacccaacaaaccgaacctaacctaactaaccccgaacggaacacccgaacgtaccgtacccctaacacgttaccgggtaccgaggtaacggacgtaccgtaagtaaggtacgtttacggaacgaccgtacggacctaagttattacgttacgtgtacgacgtaggacggtaggtacggtacgtaaccgtaacgtagtaccgnggtcggaccgacggtaccgtcgacgaccctcg

SEQ ID NO: 333500 - DNA, 687 bp, Homo sapiens
  misc_feature: GZ8MTXP02H9PZE.4.23.C01.1.454.CMB.2.raw
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctgggcctnagtgaaggtctcctgcaaggtcttgnggctactaccctttaccacctagtggtgtcacgtggtgacgacncggcccctggacagggctggagtggagtgggatggatcgagcgtacttaacgaagtcgggaaaactacgaaaactagtaccgacaacgaacgtacggttaccgaggggacacggaagtaccaaacctacgttaacccaacgaacgaccaaccacgaccgaacgaacgaccaaccgacgaccctaacgacgtacggacgtaggacggacgtaccgtaggtaagtacgtttacgggaaccgtaacgaaccgggacctaagttaactaacgtttacgtacgggtacggacggaaggtaggtaacggttacggggaccggtaaaccggtaaaccgttcggaaccggttaaccgggtacggggaaccgtaccggggtaaacccgtcgggtaccgtacccgttcccg

SEQ ID NO: 333501 - DNA, 719 bp, Homo sapiens
  misc_feature: GZ8MTXP02G6SCI.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacacctttaccacctatggtgtcaactgggtgcgacacggcccctggacaagggcttggagtggagtgggatggatcgaggcgctttaacgaagtcggggaaacaacgtaaactagtacgacaacgacggtaccgtttaccgaaggggtcacggacggttaccaacccgtaacttaacccgaaacgaacgaaaccaaccctaacgtacccgaaacgacgacccaacgacggacccctaacgaacgttaccggaccgttggaacggcggacccgtaggtaacgtagtttacggaaccggaaccgaccggtacccaagttaacttacgtttaaccgtggtacggtaccgaagggtaggtaacggtttcggggaaacccggtaaaccggtaaccgttacggtaacccgttaacgggtacgggggacccgttaaacgggggaaccccgtttcggggtaccccgtaacggtttccccg

SEQ ID NO: 333502 - DNA, 721 bp, Homo sapiens
  misc_feature: GZ8MTXP02FWO2C.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacacggccccctggacaaggggtcttaggaggtggatggggatgggatcaggcgtactttaacgaagtaggggaaacaacaaaactatacgaccacagtacgttaccgagggcacggagtccaacctacttacccaacgtaacgaccaaccaactacccgaacgaacgaccaaacgacgaccctaacgaacgttacgggacccgtaggaacgggacgtacccgtaggaacgtacgtttacggaaccgtaaccgacgggacctaacttaattaacgttaaccgttaggtacgtacggtaaaggtacggttacggttaccgggggaacccggtaaaccgggtaaaacccgttaggtaaacccgttaaccggggtaccgggggtaacccggtaaaccgggggtaacccggttaccgggttacccgttaacccggtttaccccg

SEQ ID NO: 333503 - DNA, 631 bp, Homo sapiens
  misc_feature: GZ8MTXP02I0GMR.4.23.C01.1.454.CMB.2.raw
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (435)..(435): a, c, t, g, unknown or other
  misc_feature (435)..(435): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacnccttaccacctatggtntcaacgtggtncgacacggcccctaggacgaaggcttgagtggagtgggatggatcgagcgtacttagaacgttcgggaaacctacaaacttagtcgaccaacgacgtaccgttccaggggccagggactcactactaactacacgacacactcaccagacacgtacnccgacacgtagacgcgaggngaccncgtaggacttgtacccgacgacgacgtaactagtaacttacgacgtcggacgtaggagtaacggttacgggtaaccgggtaaccggaaaacccgttcgtaaaccggtaaccgtccggggaaaccggggttaacccggaaccgggttaccggtcccggactttaacccccgg

SEQ ID NO: 333504 - DNA, 724 bp, Homo sapiens
  misc_feature: GZ8MTXP02HQA6F.4.23.C01.1.454.CMB.2.raw
  modified_base (280)..(280): a, c, t, g, unknown or other
  misc_feature (280)..(280): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctacacctttaccacctatggtgtcaacgtgggngcgacacgggccccctggacgaaggggtcttaggaggtggagtggggatggatcgaggcgctttaacgaagttggggaaacctaacgaaaacctatcgacaacgacggtaccgttacgaggggtacaggacgtaccaacctacttaacccacgaacgaccaacactacccacgacgaccacgacgacctaacagtacggacctggaggacgtccgtaggtacgtacgtttacgggaaccgtaccggaccgggtaccctaaagttacgttaaacgtttaaccgttaggtacggtaccggtaaagggtacggttaacgggtttacgggggaacccgggtaaacccggggtaaaacccgtttacgggaaacccgttaaccgggttacgggggacccgtaaccgggggtaaaccccgttcggggttacccgtaaccccggtttccccg

SEQ ID NO: 333505 - DNA, 592 bp, Homo sapiens
  misc_feature: GZ8MTXP02FI8S7.4.23.C01.1.454.CMB.2.raw
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacncctttaccacctatggtntcaacgtgggtncgacacggcccctggacaagggcttggagtggagtggatggntcgagcgactanaagtacggaaacaanaaacgttagcgacacgagaccgttacgaggactgacgtacaacctacttaaccanaacgaccacacacccaacgacacgacacgacctacgatacggacctggaacggacgtaccgtagtagtatttacgggaacgacccgacggacctaaatatagttacgtgtcgacgtagagtaggtcgggaccgacgggtaaacctggaacctggtacgggacgacggtaccgtcggccctacgtccc

SEQ ID NO: 333506 - DNA, 597 bp, Homo sapiens
  misc_feature: GZ8MTXP02JCZYC.4.23.C01.1.454.CMB.2.raw
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgagtgaagagcctgggcctcagtgaaggtctcctgcaaggcttctggctactacctttaccacctatggtgtcaacgtgggtcgcgacacggcccctggacgaagggcttgagtggatgggatggatcgaggcgacttacgaagtagggaacacaaactntcgacacagacgttcgaggcngacgtcacactaccanacgacacataccacgacgacacacgcctacagtcggacctagaacggacgtccgtaggagtactttacggaaccgaccgacggacctaatacgttacttacgtgtacgtacgaggtaggtacgttacggggaccgtaacggtaaaccgttacggacgttaaccggcgggacccgtacgggtacccgtcggacctaccggttcccg

SEQ ID NO: 333507 - DNA, 654 bp, Homo sapiens
  misc_feature: GZ8MTXP02FQFI4.4.23.C01.1.454.CMB.2.raw
  modified_base (243)..(243): a, c, t, g, unknown or other
  misc_feature (243)..(243): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctctgcaaggcttcnggctacacctttaccacctatggtgtcaacgtgggtgcgacgacggcccctggacaagggcttggagtggagtgggatggatcgagcgacttacgaagtcgggaaacaacaaactatcgacaacgagtacgttccgaagggcagtacgtaccaacctaacttaccaacaagacaacactacccacgacgacaacgacgccctaacgacgtacggacctaggaacgggacgaccgtaggacgtagtttacggaaccgtaaccgacggaccctaagttaactacgttaacgtgtacggtacgaaggtagtacggttacggggaccggtaaacggtaaacctttacggaaaccgttaacggtaccggggaccggtaaccggggtaacccgttcggtaccgtacccggttacccg

SEQ ID NO: 333508 - DNA, 670 bp, Homo sapiens
  misc_feature: GZ8MTXP02JI2U6.4.23.C01.1.454.CMB.2.raw
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcgagtgaaggtctcctgcaaggcttctggctacacctttaccactatggtntcaactgggtncgacaggcccctgacaagggcttgagtggatgggatggatcaggcgcttacaatggggaacacaaactangacacacgacgttccaggggcagagtcaccataccacagaccacgactccacgagacacaacgccctaacaacgtcgggacctggaagggacgccgtacggtaaggtatttagggaaccgtaaccgaaccgggacccgtaatttaaactaacgtttaaccgtgttacggaccggtaagacggtaaacggtttcgggggaccggttaaacccgggggtaaaacctttccgggaaaccggttaacggttacccggggggtaaccccgaaaaccggggggtaaccccctttaccgggggtacccgtaaaccccggtttccccgg

SEQ ID NO: 333509 - DNA, 641 bp, Homo sapiens
  misc_feature: GZ8MTXP02JKGR1.4.23.C01.1.454.CMB.2.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtgggcctcagtgaaggtctcctgcaggcttngctacaccttaccacctntggtntcacgtggtgacgacacggccccgtaggaccgagggtcttaggaggttggacgtgggagtggatcgaggcgacgttaacgaagtcgggaaaacacgtaaaactgtacgacacgaagtaacccggttcgaacggggtcaggtacgtactacgttaacctaaccgtaacgaacaccgaactacgtaaccaccggaacgacaacaccgacctaacgacgtacgacggtacgagggaagacgtaccgtagaacgttcggtaaacgacgaaccgacgactataattaccgtagttacgaaggtacggtagtaagggacgtaacggtaccggaaacgtacgtacgtaacgtcgggacgaacggtccgtacgtacgtaccgtccg

SEQ ID NO: 333510 - DNA, 644 bp, Homo sapiens
  misc_feature: GZ8MTXP02H92TO.4.23.C01.1.454.CMB.2.raw
  modified_base (246)..(246): a, c, t, g, unknown or other
  misc_feature (246)..(246): n is a, c, g, or t
  modified_base (539)..(539): a, c, t, g, unknown or other
  misc_feature (539)..(539): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttctggtggcagcagcaacaggtgcccactcccaggttcacctggagcagtctgggacctgaggtgaagaagccgtggggcctcgagtgaaggtctcctgcaaggtcttcnggctactaccctttaccacctagtggtgtcaacgtggtgcgacgacggcccctggacgaagggtcttaggaggtggagtgggatgggatcgaggcgtcttaacgaaagtcgggaaacaacaaacgtagtaccgacaacgagtaccgttcgaggggcagacgtacacctagttaacccacaacgaccacacaccacgacgacacacgacctaacgacgacggacgtaggacggacgaccgtaggtagtagtttacgaaccgtacgaaccggacctaagtaactagttacgtagngacgagagtacggttacgggaccggtaaacggtaaccgttacgaaccggtaacggtacggggaacccgaacgggggtacccgtacgggtacctaacccggtcccg

SEQ ID NO: 333511 - DNA, 571 bp, Homo sapiens
  misc_feature: GZ8MTXP02FGCRJ.4.23.C01.1.454.CMB.2.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (499)..(499): a, c, t, g, unknown or other
  misc_feature (499)..(499): n is a, c, g, or t
  modified_base (565)..(565): a, c, t, g, unknown or other
  misc_feature (565)..(565): n is a, c, g, or t
tcagagcactgtagcacgaccggtgctcgatttagtacacgtgattagggattgggggacccaaaaaccacacccctccttgggcgaatcccctagatcacagctcctcaccatggactggacctggagcattcctttttcttggtggcagcagcaacaggtgcccactcccaggttcacctggagcagtctggacctggaggtgaagaagccgtggggcctnagtgaaggtcctctgcaaggtcttngctacacctttaccactatggtntcaacgtgggtncgacacggcccctaggacgaagggtcttggaggtggagtgggatggatcgagcgctaacagtacgggaacactaaactncgacagagccgttacgaggnagacgtacaactactaccacaagtacacactaccgacganacaacacgacctanaacgtggacctggaggacgctagagtattacgacacgacgacaatatatacgtgagtacgganaggtacgtcgggaccgaacggtaaacctggactaacgggtcgggaccgacgggtaccctgggaccncgtacc

SEQ ID NO: 333512 - DNA, 674 bp, Homo sapiens
  misc_feature: GZ8MTXP02GFB2O.4.23.C01.1.454.CMB.2.raw
  modified_base (266)..(266): a, c, t, g, unknown or other
  misc_feature (266)..(266): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagcctggggcctcagtgaaggtctcctgcaaggcttctggctacaccttaccacctatggtntcacgtggtgcgacacggcccctggacaagggcttgagtggatgggatggatcgagcgtacttaacgaagtacgggaaacaacgaaaactatcgaccaacgaggaacgttccgaagggtacgaggtacgtaccaacctacgttaacccaacgagaaccaacactaccgacgacgacaccacgaccctaacgagtacggtaccaggaaggaacgtccgtaggtagtagtttacggaaccgaacgaccgggtacctaagttaacttacgttaacgtggtacgcggaaaggaggtacggtttacggggaacccggtaacggtaaacccgttacggtaaccgttaaccgggtaccgggggaaccgtaaccgggggtaaccccgttacgggtaccccgtacccgtttacccgg

SEQ ID NO: 333513 - DNA, 666 bp, Homo sapiens
  misc_feature: GZ8MTXP02H23IN.4.23.C01.1.454.CMB.2.raw
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (326)..(326): a, c, t, g, unknown or other
  misc_feature (326)..(326): n is a, c, g, or t
  modified_base (359)..(359): a, c, t, g, unknown or other
  misc_feature (359)..(359): n is a, c, g, or t
  modified_base (383)..(383): a, c, t, g, unknown or other
  misc_feature (383)..(383): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctactacctttaccacctatggtgtcaacgtgggtncgacncggcccctggacgaagggctggagtggagtgggatggancgagcgacttaacgaagtgggaaacacaaactntcgacacagtacgttacgagggcnggactcaccataccacagaaccacacaccacgacgcaacacgaccctacgtacgtacggactaggaacggacgtaccgtaggtacgttagtttacggaaccgtaaccgaccgggtaaccctaagttaacttaacgtttaacgtaggtacggtacggtaaggtaaggttaacggtttaccgggggaacccggtaaaccggggtaaaacccgtttacggtaccgttaaccgggtcgggggtaacccgtacggggtaaccccgtcgggtacccgtacccggttccg

SEQ ID NO: 333514 - DNA, 702 bp, Homo sapiens
  misc_feature: GZ8MTXP02I1XDQ.4.23.C01.1.454.CMB.2.raw
  modified_base (464)..(464): a, c, t, g, unknown or other
  misc_feature (464)..(464): n is a, c, g, or t
  modified_base (493)..(493): a, c, t, g, unknown or other
  misc_feature (493)..(493): n is a, c, g, or t
tcagagcactgtagcacgaccggtgctcgattttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtagaagagccgtggggcctcagtgaaggtctcctgcgtaaggcttcgtggctactacccttacaccgttatggtacgtacaacgtgggtgacgacacggccccgtaggaaccgtaagggtcctttagacggttggagtgggataggactacgagtcgaacctttagaagtacgggaaacaacgtaaacgtagtaccgacacgagtaccgttaccgaagggtccagtactaccgaaacctactaaccgaacgagaaccactaacncccgacgacaccaacacgtaccctaaacngtacggaccgtggaaaaccggtgtaccgtagtaacgttagttacggaaaccgtaccgaccgggtaacctagttaacggttaacttagtacggtacgtaacggacggtaggtaacggttaccgggaaacgtaacggtaaaacccgttcgaacgttaacgggaccggtaccgtaaacggggtacccctagggtaccccaacgtttccccgg

SEQ ID NO: 333515 - DNA, 667 bp, Homo sapiens
  misc_feature: GZ8MTXP02GU857.4.23.C01.1.454.CMB.2.raw
  modified_base (184)..(184): a, c, t, g, unknown or other
  misc_feature (184)..(184): n is a, c, g, or t
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (390)..(390): a, c, t, g, unknown or other
  misc_feature (390)..(390): n is a, c, g, or t
  modified_base (458)..(458): a, c, t, g, unknown or other
  misc_feature (458)..(458): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggancagtctggacctgaggtgaagagcgtgggcctcagtgaagtctcctgcaggcttcngctactaccttacactatggtgtacaagtgggtncgacgacggccccgtggacaagggctaggagnggagtgggatggatcgaggtcgtacttaanaaggtagggaaacaacgtaaaactatcgacaacgaacgtacgtaccgagggacnggaacgtaccaaccgtaacttaaccacgaacgaccaacacgtaccacgacgacctaacacgaccctanacgtacgaaccgtaggaaggaccgtacgtacggagtacgtttacgggaaccgaaccgtacccggactaaacgttaattaacgttaacgtgtacggacgacggtaaaggtacgttacgggggaaccccgtaaacggtaaaccgttacggaaccgttaacgggaccggggaccgaaccggggtacccgtacggtccgaacccgtttccccg

SEQ ID NO: 333516 - DNA, 614 bp, Homo sapiens
  misc_feature: GZ8MTXP02HDNRO.4.23.C01.1.454.CMB.2.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggtcttcnggctacaccctttaccacctatggtntcaacgtggtgcgacgcggcccctggacagggtcttggagtggagtgggatggatcgagcgactagaagtgggaaacacaaactatcgacacagtacgtcagggcagcgtacactataccacaacgacacgactcccgaagacgacaccgacgaccctaacgacgtacggaaccgtggaaacggtacgccgtaggtacgtacgttacggaaccgacgaccggtaccaagttactacttacgtgcgaacgagagtacggttacgggaccgtaacggtaaaccttggaaaccgtcgggtacggggtacccgacggggtaacccgttcggacccgtaaccgttcccg

SEQ ID NO: 333517 - DNA, 611 bp, Homo sapiens
  misc_feature: GZ8MTXP02F0BPL.4.23.C01.1.454.CMB.2.raw
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttntggctacacctttaccacctatggtgtcaacgtgggtgcgacacggccccnggacaagggcttgagtggagtggatggaatcgagcgtctaacagtagggaacaacgaaactatcgacacagtacgttccgaggacgagacgcaaccgaattaccaacagacaacactacccacgacgacacacgacccgtacactacgggacctaggacggacgacccgtagagtacgtttaggacgtaccgacggtaccaattaactattaaccgtgttacgaccggaggagaacggtttcgggaccgtaacccggaaacgttagaccgtaacgggtcggggaccgtacgggtacccgtcggtaccaccggttaccc

SEQ ID NO: 333518 - DNA, 615 bp, Homo sapiens
  misc_feature: GZ8MTXP02GO7UE.4.23.C01.1.454.CMB.2.raw
  modified_base (445)..(445): a, c, t, g, unknown or other
  misc_feature (445)..(445): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacaggcccctggacaagggctgaggtggagtgggatggatcgaggcgcttacaagtaggggaaacaacaaactatacgacacagacgttaccgagggacagacgtccaaccgtacttaacccacaacgaaccaacactacccaacgacgacacacgaccctanacgtcgaccgtgagacgccgtgtacgtagtttacgacgaaccgaccggaccgaattaattattaccgtgtacggacgaagagtacggttcgggaccggaacggtaaaccgttacgaaccgtaacgttacggggaccgtacgggaacccgtacggtacccgtaacgtcccg

SEQ ID NO: 333519 - DNA, 628 bp, Homo sapiens
  misc_feature: GZ8MTXP02I2M7D.4.23.C01.1.454.CMB.2.raw
  modified_base (340)..(340): a, c, t, g, unknown or other
  misc_feature (340)..(340): n is a, c, g, or t
  modified_base (543)..(543): a, c, t, g, unknown or other
  misc_feature (543)..(543): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccagattcacctggagcagtctggacctgaggtgaagaagcctggggcctcagtgaaggtcctccgtgacgaaggtcttcgtggccttacctacctttacccaccttagtggtacgtcaacgtgggtgcgacgacggccccgtaggacgtaacgggctttaggaggtgggagnggggatggatcgaggtccgtacttaacgaaggtacgggtaaaccaacgtaaactagtacgacacgaggtacgttccgagggtcattacgaccaccgtactacaacacgacacactaccgagacgacacacgacctagacgtcgaccgtaggacggcgacgtagagttgttaacgaacgacgtacgcgtaatagttattaacgngtacggacgtagacgtacggtacggaccggtaacgtacgttacgaacgtacggtcgggaccgaccggtacgtcgtaccgtacccg

SEQ ID NO: 333520 - DNA, 725 bp, Homo sapiens
  misc_feature: GZ8MTXP02JRDMI.4.23.C01.1.454.CMB.2.raw
  modified_base (270)..(270): a, c, t, g, unknown or other
  misc_feature (270)..(270): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtggggcctcagtgaaggtctccgtgcaaggtcttctgctactacctttaccacctatggtntcaacgtggtgcgacgacggcccctggacgaagggcttgaggtggagtgggatgggatacgagctacgttaactaagttaggaaacaaacgtaaaacttatccgactaacgaacgtaccgttaccggagggtacagtacgtacaaccctaacttaacccacgtaaacgaccaaacgaccgtacccgaaacgaacgccaaaccgtaacgccctaaacgacgttacgggacccgtagggaacggacgtaccgtagggtaagttagtttaacgaaccggtaaaccgacccggggtaccgttaagttaaaccttaaggtttaccgtaggtacggtacggaaggtaaggaccgggttacggggtaaccggaaaacccggtaaacgttcgtaaccggtaaccggtacggggtacccgggaacgggtaacccggtttccggtaaacccgtccggttaccccg

SEQ ID NO: 333521 - DNA, 762 bp, Homo sapiens
  misc_feature: GZ8MTXP02I3GW3.4.23.C01.1.454.CMB.2.raw
  modified_base (383)..(383): a, c, t, g, unknown or other
  misc_feature (383)..(383): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaacggtctccgtgcaaggcttctggctacacctttaccgactatggtgtcaacgtgggtgcgtacgacggccccgtaggaaccaagggtccttaggaggtcggagtggggatgggatcgacggcgtacttaacgaagtacggggaaacacgaaaacgttnaccggacacgacgtaccgttacgagggacaggtaacgtccaaaccgtacgttaaccaacgacgaacaactactacccgaacgacgacctaacgacgacccttaacgaacgtcggaccctgggaagtacggaccgtaggtaacgtacgtttacggaaccgtaaccgtaccgggacccttaaagtacttaacgtttaaccgtagggttacgacggtaaaggtaggttaacgggtttaccgggggaaccccggtaaaaccggggttaaaacccgtttaccgggaaaccgtttaaacccgggggtaccgggggtaacccccggaaacgggggtaaaccccccgttacgggggttaacccctaccccgggggttttaacccccg

SEQ ID NO: 333522 - DNA, 675 bp, Homo sapiens
  misc_feature: GZ8MTXP02GRX0L.4.23.C01.1.454.CMB.2.raw
  modified_base (285)..(285): a, c, t, g, unknown or other
  misc_feature (285)..(285): n is a, c, g, or t
  modified_base (330)..(330): a, c, t, g, unknown or other
  misc_feature (330)..(330): n is a, c, g, or t
  modified_base (433)..(433): a, c, t, g, unknown or other
  misc_feature (433)..(433): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcgagtgaaggtctcctgcaaggcttctggctacacctttaccactatggtgtcaacgtgggtgcganacggcccctaggacgaagggcttgaggtggagtggggagtggaancgagcgtacgttaaacgaagtaggggaaacaactaaaactagtacgaccgaacaggaccgtttacgagggacagggtacacaaaccctattaaaccgacgaanacacgactaccacgagaccacacgacctacacgtaggtacctaggaaggacgctacgggtagtactttacggaaccgaacgaccggtaactaactaaagttaacgtttacgagttacggacggaaaggtaacggtacgggtttacggggaaacccggtaaccgggtaaaaccgttacggaaccggtaacggtacggggtacccgaacggggtaaccgttcggtaaccgtaacccgtttcccg

SEQ ID NO: 333523 - DNA, 652 bp, Homo sapiens
  misc_feature: GZ8MTXP02F99CK.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcagtgaaggtctcctgcaaggcttctggctacacctttaccacctatggtgtcaacgtgggtgcgacgacggcccctaggacgaagggcttggagtggagtgggatggatcgagcgtacttacgaagtagggaaacaacaaaactagtcgacaacgagacgttccgaggcaggtacgtcaaacctaacttacccaacaacgaaccaacaactaccgaacgacgacaacacgacctaacacgtacggacctaggaacggacgaccgtagaagtagttacggaacgaaccgacggaccaattaactacgttacgtaggttacgacggaaggaaggtacggttacggggaaccggtaacggtaaaaccgttcggaaccgttaacggtacggggaacccgtaacggggtaacccgtacgggtaccgtacccgttcccg

SEQ ID NO: 333524 - DNA, 723 bp, Homo sapiens
  misc_feature: GZ8MTXP02JUNHG.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtcgcccactcccaggttccaccgtggagcagtctggacctggaggtagaaggaaggccgtggggcctcgagtggaacggtctccgtggcaaggtcttcgtcggtacctacctaccctttaccacctagtcggtagtcaacgtgggtcgacgacgcggcccgtaggacgagggtcttggagtggaggtggagtggatcgacgcgtacgttacgaaggtacggaaacctaagtaaactagaccgtacgacgacggtaccgtacggaggacgagaccgtacaaccgtaactaaccgacgaacgaacctaacgaacgtacccgaacgacgaccgaaccgacgtaacccacgtaacggtacgaccgtagggggaggtacccgtacggtagtaaggttacgttaccgggaacgaaccggtaaccggaccttaaagttaacttaacgtttcgtgggacgtacggtaagtacgggtacggtacgggtaccggtaaaccggggttaacttacgggtaccgtaacgggccgggtaaccggaccggggtaaccgtccggtaccgtacccgttccg

SEQ ID NO: 333525 - DNA, 675 bp, Homo sapiens
  misc_feature: GZ8MTXP02IP9HD.4.23.C01.1.454.CMB.2.raw
  modified_base (475)..(475): a, c, t, g, unknown or other
  misc_feature (475)..(475): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagctggggcctcagtgaggtctctgcagtcttctgctactaccttaccaccttagtggtgtctaacgtggtgcgacgcggcccctggacgaaggcttggagtggagtgggatcggatcgagccgtacttacgaagtagggaaaccaacgtaaaactagtaccacaccgacggtaaccgttacccggacggggacacgggtaacgttaccaacctaaaccttaacccgaacgaacaaccaacacacccgaacgacacaaaccagaccctaanacgtcggacccgagggacgacgtccgtaggtaacgttcgtttacggaaccgaacgtaaccggacctaagttaattactttacgtgttacgacggaagtaggtacgttaccggggaccgtaaaccggtaaccgttacggaacgttaaccgggtcgggaccgaaccggggtacccgttacggtacccgtaacccggttcccg

SEQ ID NO: 333526 - DNA, 640 bp, Homo sapiens
  misc_feature: GZ8MTXP02I7NCQ.4.23.C01.1.454.CMB.2.raw
  modified_base (366)..(366): a, c, t, g, unknown or other
  misc_feature (366)..(366): n is a, c, g, or t
  modified_base (414)..(414): a, c, t, g, unknown or other
  misc_feature (414)..(414): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtgggcctcagtgaaggtctctgcaaggcttctggctactacctttaccacctatggtgtcaacgtgggtgacgacacggcccctggaccgaagggtctggaggtggagtgggatggatcgaggcgtacttaagaagtacgggaaacaacgtaaactncgacacgagtaccgtacgagggcaggacgtacaacctacttaaccganaacgaccaacactaccgacgacaccaacacgacctaacagtacggacctagggaacggactccgtaggtacgtattacgggaacgaaccgacggactaagtaacttacttaacgtgtacgacgaaggtaggtacggttaccgggaccggtaaacggtaaaccttcggtaaccgtaacgggtacggggaccgtaaccgggaacccgttcggtaccgtaccgttcccg

SEQ ID NO: 333527 - DNA, 701 bp, Homo sapiens
  misc_feature: GZ8MTXP02IVIUH.4.23.C01.1.454.CMB.2.raw
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagagccgtgggcctcagtgaaggtctccgtgcaaggtcttcgtggctacctacctttaccacctagtggtgtctaacgtgggtgcgacgaccggcccctaggaccgaagggtcttaggaggtggagttgggatggactcgaggtccgtactttaacgaagtacgggaaactaaccaaaatacgtacgaccaacgacgtacccggttacgacgggactagtaccgtacaccctaacgttaaccccagtaaacgaccaaactactacccgaaacgactaccacaacgacccttacgaacgttaccgggaccgtaggacggtacgtccggtagtaaccgttagttacgggaaccgtacgaaccggtaccttaaagtaactttaagttaccgttagaccggtagaacggtagtacgttacggggaaccgtaaccgtaacgtttcgaaccgttaacggtacgggaacccgtacgggaccgttacggtaccgtaacccggttccg

SEQ ID NO: 333528 - DNA, 666 bp, Homo sapiens
  misc_feature: GZ8MTXP02IE17U.4.23.C01.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagctgggctcagtgagtctctgcagctctgctacaccttacactatggtntcaacgtggtgcgacacggccctggacaaggcttgaggtgngtgggatggatcagcgtacttacgaagtgggaaacacaaaactatacgacacagacgttaccgagggctagtacgtacaaccctatttacccaacgtacgaacaaccactacccgaacgaacgacaaccacggacccttaacgaacgttcgggaaccttggaacgggtacgacccgtaggtaacgtacgtttacggaaccgaccgtaaccggaccctaagttaactaacgtttacgtgtacggtacgaaggtacgtaacggttacggggaaccgtaaccgggttaaaaccgttcggaaacgttaaccggtaccgggggtaacccgtaacgggggtaaaccccgtcgggtttacccgaacccgtttccccg

SEQ ID NO: 333529 - DNA, 619 bp, Homo sapiens
  misc_feature: GZ8MTXP02HQU1E.4.23.C01.1.454.CMB.2.raw
  modified_base (272)..(272): a, c, t, g, unknown or other
  misc_feature (272)..(272): n is a, c, g, or t
  modified_base (516)..(516): a, c, t, g, unknown or other
  misc_feature (516)..(516): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcgagtgaaggtctcctgcaaggcttcgtggctactacctttaccacctatggtntcaacgtgggtgcgacacggcccctggacaagggcttggagtggagtgggatggatcgagcgtacgttaacaagtacgggaaacaacaaactatcgacacagtaccgttcgacggcaggactacaaccacttacccacgacgaaaccacaacacccgaacgacgacaacgacgtaccctacgatacgggacctagggagacgtacgtgaagtagttacgacgacgacgactatacgtattacgngtagacgtaagtaggtacgttcggggaaccgtaacggtaaaccgtcgaaccggttaacggacggggacccgacgggtaacccgtcggtaccgtaaccgtcccg

SEQ ID NO: 333530 - DNA, 671 bp, Homo sapiens
  misc_feature: GZ8MTXP02F5AAS.4.23.C01.1.454.CMB.2.raw
  modified_base (359)..(359): a, c, t, g, unknown or other
  misc_feature (359)..(359): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagccgtggggcctcgagtgaaggtctcctgcaaggcttctggctacacctttaccacctagtggtgtcaacgtgggtgcgacacggcccctggacgaagggcttaggagtggatgggatggatcgagcgtactagaagtagggaaacacaaatncgacacagacgttcgagggacaggacgtcaaccacgttaccaacagacacatacccgagacgacaacgaccgacctaacgagtacggaccgaggaacggacgtaccgtaggaccgtaagtttacggaacgtaaccgaccggtacctaagttaactttaagtaccgtttacggtacggtacggtaacgtaaagggtacggttaccgggggaacccgtaaaccggggtaaaaacccgttcgggtaacccgttaacgggtacggggaaccggtaaacccggggtacccgtaccgggtaacctcccgggttacccg

SEQ ID NO: 333531 - DNA, 670 bp, Homo sapiens
  misc_feature: GZ8MTXP02JX3RN.4.23.C01.1.454.CMB.2.raw
tcagagcactgtagcacgaccggtgctcgatttagtacacgtgattagggattgggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaacgtgggtgcgacacggcccctggacaaggggcttaggaggtggagtgggatggatcgaggcgactttaacgaagtgggaaacaacaaactatcgacacagtacgttcgagggcagacgtaccacctataccacaagaccaacactacccaacgacgaccaacacgaccctaacgacgtaccggaccgtaggaaacgggacgacccgttaggaagttacgtttacgggaaccgaaccgaccggtaccaagttaacgttaactttaacgtaggtcggacggtaaggaggtaacggttaccggggaccggtaaaccgggaaaccgtttacggaaccgttaaccggtaccgggggaaccgtaaccgggggtaaccccgtcgggtacccgtacccgtccccg

SEQ ID NO: 333532 - DNA, 700 bp, Homo sapiens
  misc_feature: GZ8MTXP02J0BXL.4.23.C01.1.454.CMB.2.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (505)..(505): a, c, t, g, unknown or other
  misc_feature (505)..(505): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtagaagaagccgtggggcctcgagtgaaggtctcctgcaaggcttctggctaccacctttaccactntggtntcacgtggtgacgacncggccctggacgaagggcttggagtggagtgggatggatcgaggctacgttaacgaagtacgggaaactaaccgaaaactagacgtaccgactacggtaaccgttacggaaggggtaccagggtaccgtaccgaacctaacttaaaccgaacgaacgaacccaacaactacccgaacgacggaaccaacgacgtcccaaacgtacgtaccgggtaacnggaacgggactaccggtgaacgtacgttacggaccgaacgaccggactattaaacgtagttacgtaggtacgacgaaggtaggtaacgggttaccggggaaaccccgtaacgggtaaaacccttcggaaaccgttcggaaccccgggggtacgaacccgggggttaccgttccggacccgtaccggtttcccccg

SEQ ID NO: 333533 - DNA, 658 bp, Homo sapiens
  misc_feature: GZ8MTXP02FVT2A.4.23.C01.1.454.CMB.2.raw
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcattccttttcttggtggcagcagcaacaggtgcccactcccaggttcacctggagcagtctggacctgaggtgaagagccgtggggcctcaggtgaaggtctccgtgacaggtcttcgtggcctaccgtaccctttaccaccttagtcggtgtactaacgtgggtgcgacgacggccccgtaggaccgaaggtcttaggaggtggacgtggggtatgggactcgaggtcgtacttaacgaaggtacgggaaacaacgtaaactgtacgacgtaacacggtaccgttaccggaacggggctacggacgttaccgaaaccttaactacccaacgagaccctaaacgtactacccagacgacacgtacncctaacngtacgacgtaggacgacgctagagtagttacgaacgaccgtacggactagttaactacttacgtggtagacggtaggtacgtcggttacggggaccgtacggtaaacctgaacgtaacgggtcggaccggacggtacccgtggacccgtacgtccg

SEQ ID NO: 333534 - DNA, 692 bp, Homo sapiens
  misc_feature: GZ8MTXP02INIDP.4.23.C01.1.454.CMB.2.raw
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
  modified_base (547)..(547): a, c, t, g, unknown or other
  misc_feature (547)..(547): n is a, c, g, or t
tcagagcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcgagtgaaggtctcctgcaaggcttntggactacaccctttaccaccttagtgtgtcaacgtggngcgacaggcccctggacgaggcttgagtggatggagtgagtcgagcgtacttacgaagtcgggaaaacacaaaactntacgacaacacgacgttacgaggacagagtacacctaataacacgagtacaccgtactacccaacgagaccacacgcctaaacacgtaccggacccgtaggaaacgggacgtcccgtagtaaacggtacgtttaccggaccggaaaaccgtaccggggaccctaaagttaacttaagtttaaacccgngttaaccggtacggtacgaagggtttaacggtacggggtaaacccggtaaaccgggttaaaccgttaacgaccggtaaaccggtcggggtaaccccggtaaacgggggtacccccgtaaggggttcccctaacccggtttacccg

SEQ ID NO: 333535 - DNA, 638 bp, Homo sapiens
  misc_feature: GZ8MTXP01DL39N.44.32.C10.1.454.CMB.2.raw
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagacagtatatacacgaccggtgctcgatttagtatagacatcaacacacaaaggggggtctcaggaggcagcactctcgggacgtctccaccatggcctgggctctactcctcctcagcctcctcactcagggcaaagggtcctggggactgtctaccctgactcagccgccctcagtgtccgggactcctggtcagtcggtcaccatcttctgttcttccagcgacaattccactggcccttaaagtctctatcatgtacgcagtggtcccgggccgagcccctaaagtcctctttacgacgtcctttcgcgggcttcggcacgtccctggtccgtttttcggcccttcctagttctcgtaccacgccggcccctccctgacccatccaaccaaactccggcctgagatgagctgtactactttgtgngtctnttatttcgattcaactacaaattagtcgttcggtttcgggaaaggttcgggaccccgcggtcacggtcgttcccgttgccgttaccacggccccgaaacgggccccaaaccccgtaccgttcgtccgtaacccttccgtttccgtttcccccgtccccttcccttaacccttaattaccgttacctttcgttcccgttggg

SEQ ID NO: 333536 - DNA, 576 bp, Homo sapiens
  misc_feature: GZ8MTXP01CPZ2I.44.32.C10.1.454.CMB.2.raw
tcagacagtatatacacgaccggtgctcgatttagtatagacatcaacacacaaaagggggggggtctcaggaggcagcactctcgggacgtctccaccatggcctgggctctactcctcctcagcctcctcactcagggcaaagggtcctggggactgtctaccctgactcagccgccctcagtgtccgggactcctggtcagtcggtcaccatcttctgttctcagcgacaattccactggccctttaaagtctctatcatggtacgcagtggtccccgggccgagcccccaaagtccctctttacgactccttcgcgggcttcggcagtcccctggccgtttttcggccttccagttctgaccacgcggccccctccctgaccatccaaccaaactccgcctgagatgagctgactacttttgtgtgctatatttcgattcactcaaatatgttcgttcggaaggtcgggacccgtcgtcgacgcgtcctgtcgtcacgcccaaggccccaacccctcttcggtccacttccttcgttccccgccctccctcttatacttactcgttcgtcgg

SEQ ID NO: 333537 - DNA, 544 bp, Homo sapiens
  misc_feature: GZ8MTXP02HJP88.44.32.C10.1.454.CMB.2.raw
  modified_base (465)..(465): a, c, t, g, unknown or other
  misc_feature (465)..(465): n is a, c, g, or t
tcagacagtatatacacgaccggtgctcgatttagtatagacatcaacacacaaagggggggtctcaggaggcagcactctcgggacgtctccaccatggcctgggctctactcctcctcagccccctcactcagggcaaagggtcctggggactgtctaccctgactcagccgcctcagtgtccgggactcctggtcagtcggtcaccatcttctgttcttccagcgacaattccactggaccctttaaagtctctatcatggtacgcagtggtcccggccgagcccccaaagtcctctttacgacgtccttcgcggcttcggcagtccctggccgttttcggcctccagttctgaccacgcgcctcccctgaccatcaccaaactccgcctgacgatgagctgactactttgtgtgcatatttcgattcactcaaaatatgtcttacggaagttcgggacccngtcagcgtctgcgtcagcccaaggcccaaaccccatcgcactctcgtcccgccctcctctaactcacctgtactgacgg

SEQ ID NO: 333538 - DNA, 702 bp, Homo sapiens
  misc_feature: GZ8MTXP02ITPRZ.44.32.C10.1.454.CMB.2.raw
  modified_base (357)..(357): a, c, t, g, unknown or other
  misc_feature (357)..(357): n is a, c, g, or t
tcagacagtatatacacgaccggtgctcgatttagtatagacatcaacacacaaaggggggggtctcaggaggcagcactctcgggacgtctccaccatggcctgggctctactcctcctcagccctcctcactcagggcaaagggtcctggggactgtctaccctgactcagccgccctcagtcgtccgggactcctggtcagtcggtcaccatcttctgttccttccagcgactaacttcccacttcggtacccttttaaagtccttactatcctagttggtaccgctaagtcgggtcccgggccgacgcccccaaagttccctctttacgacgttcctttcgcggtcttcggcncgtcccctggttccgttttcggcccttcagttctcgaccacgccgccctccctgccactcaacctaactccgctgacggtctgacggctagtacttacgtttgtgtgctagttattccgtattcgactactaaattgttcgttacgttacgggtaagtcccggggtacccgtcgttccgaggtccgttccgtcggtccgttaccgacgacccccgtaacgggtaccccctaaacccccgtaacgttccggtaaacctcccgttccgtttaacccggtttacccccctcccgttaccccttactttaaccgttaccgttacccgtttcggttcgtttaacccgggg

SEQ ID NO: 333539 - DNA, 561 bp, Homo sapiens
  misc_feature: GZ8MTXP02HFGXZ.44.32.C10.1.454.CMB.2.raw
  modified_base (420)..(420): a, c, t, g, unknown or other
  misc_feature (420)..(420): n is a, c, g, or t
tcagacagtatatacacgaccggtgctcgatttagtatagacatcaacacacaaagggggggtctcaggaggcagcactctcgggacgtctccaccatggcctgggctctactcctcctcagcctcctcactcagggcaaagggtcctggggactgtctaccctgactcagccgccctcagtgtccgggactcctggtcagtcggtcaccatcttctgttcttccagcgacaattccactggccctttaaagctctatcatgtacgcagtgtccggccgacgccccaagtcctctttacgacgtcctttcgcggcttcggcagtccctggtccgttttcggccctcctagttcctgaccacgcggcccctccctgaccactcaccaactccggcctgagatgagctgacttacttttgtntgctattatttcgatttcacttcaaattatgttcttcggaagtcgggacccgcgtcaggcgtcctgctcgacgcccaacggcccaaacccgctcgtcacgtcctcgttcccaacccttccgtctactacgtactcgtactg

SEQ ID NO: 333540 - DNA, 635 bp, Homo sapiens
  misc_feature: GZ8MTXP02GDGAN.44.32.C10.1.454.CMB.2.raw
  modified_base (265)..(265): a, c, t, g, unknown or other
  misc_feature (265)..(265): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
tcagacagtatatacacgaccggtgctcgatttagtatagacatcaacacacaaagggggggggtctcaggaggcagcactctcgggacgtctccaccatggcctgggctctactcctcctcagcctcctcactcagggcaaagggtcctggggactgtctaccctgactcagccgccctcagtgtccgggactcctggtcagtcggtcaccatctctgttctcagcgacattccatggtacccttaagtctctatcatggtacncagtcggtcccggccgacgccccaaagtccttctttacgacgttccttcgcggtctcggcagtcctggtccgttttcgctcagttcngaccncgcgccctccctgaccactcaaccaacgtccgcctggagatgacgtctgtacttacttttgtgtgctattacttcgtatttcaacttacaaattattgtacgtttacgggaagttcgggtacccgtgttaccgnggtccgttccgngtccgtacgaccggacccgaaacggtcccccaaacctaccggttacgtcccgtaaccttcccgttcccggtttacccccccgtccccgttaccctttacgtaacttaccgttaccgttacgttaccgtacgg

SEQ ID NO: 333541 - DNA, 449 bp, Homo sapiens
  misc_feature: GZ8MTXP01EYKFI.22.29.C07.1.454.CMB.2.raw
  modified_base (438)..(449): a, c, t, g, unknown or other
  misc_feature (438)..(449): n is a, c, g, or t
tcagacatacgcgtcacgaccggtgctcgatttagagtgctacgaagggaaggggctggagtgggtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtgactacctactttctcgacgtggggccagggaccctggtcaccgtctcctcagcctccaccaagggcccatccggtcttccccctggccgccctgcctccaggacgccaccctccgagacgcacacgccggcccccctggggctgccgtggtacaagggctactccacgcgtatgtctgacgtcgggctgggcaaggcgacagtagnnnnnnnnnnnn

SEQ ID NO: 333542 - DNA, 509 bp, Homo sapiens
  misc_feature: GZ8MTXP01EZLHX.22.29.C07.1.454.CMB.2.raw
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
  modified_base (448)..(448): a, c, t, g, unknown or other
  misc_feature (448)..(448): n is a, c, g, or t
  modified_base (476)..(482): a, c, t, g, unknown or other
  misc_feature (476)..(482): n is a, c, g, or t
  modified_base (484)..(509): a, c, t, g, unknown or other
  misc_feature (484)..(509): n is a, c, g, or t
tcagacatacgcgtcacgaccggtgctcgatttagagtgctacgaagggaaaggggctggagtgggtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtnactacctattcncgactgggccaggaccctggtccaccgtctcctnacgcctccaccaagggcccatccggtccttcccccnggccgccctgctccgaggcncaccctcgagacgcacgacggtccggcccccgtggggctcgccctggggtaaccaaagggcccttaccgttcccgaacgtcggttaattcgggtcctagggacgcgggggtcncgggggacaacggggcgttacaaagtgnnnnnnngnnnnnnnnnnnnnnnnnnnnnnnnnn

SEQ ID NO: 333543 - DNA, 376 bp, Homo sapiens
  misc_feature: GZ8MTXP02G513G.22.29.C07.1.454.CMB.2.raw
  modified_base (369)..(376): a, c, t, g, unknown or other
  misc_feature (369)..(376): n is a, c, g, or t
tcagacatacgcgtcacgaccggtgctcgatttagagtgctacgaagggaaagggccggttcaccactctccaggagaccaattcctaagaacacgctgtatttgcaaatgaacagcctgagagccgaagacacggccgtctattactgtgtcgagattaccgcattaacggtgactacctactttctcgactggggccagggaaccctggtcaccggtctcctcagcctccaccgaagggcccatccggtcttcccctggcgccctgctccaggacgccacctccgagagcacagcggccctgggcctgcctggtccaagggactacttccacgtcgttgctgagacgggctggcaaggcgcatacgnnnnnnnn

SEQ ID NO: 333544 - DNA, 434 bp, Homo sapiens
  misc_feature: GZ8MTXP02JD7S8.22.29.C07.1.454.CMB.2.raw
  modified_base (421)..(421): a, c, t, g, unknown or other
  misc_feature (421)..(421): n is a, c, g, or t
  modified_base (427)..(434): a, c, t, g, unknown or other
  misc_feature (427)..(434): n is a, c, g, or t
tcagacatacgcgtcacgaccggtgctcgatttagagtgctacgaagggaaggggctggagtgggtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtgactacctactttctcgactggggccaggggaaccctggtcaccgtctcctcagcatcccaccaagggccccatccggtccttccccctggccgcccctgcctccaggcgccacctccgagacgcacagcccggccctgggctgcctggcaggctactccgacgcgtatgtctgagcggctggcaaggcncatagnnnnnnnn

SEQ ID NO: 333545 - DNA, 418 bp, Homo sapiens
  misc_feature: GZ8MTXP02HDQ6P.22.29.C07.1.454.CMB.2.raw
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (410)..(418): a, c, t, g, unknown or other
  misc_feature (410)..(418): n is a, c, g, or t
tcagacatacgcgtcacgaccggtgctcgatttagagtgctacgaagggaaaggggctggagtgggtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtgactacctactttctcgactggggccaggggacccctggtcaccgtctcctcagcctccaccaaggcccatcggtctcccctgcnccctgctcagcgcacctcgangcacagcgccccctgggctgcctggtcaaggctactccacgcgtatgtctgagcggctggcaggcgcatagnnnnnnnnn

SEQ ID NO: 333546 - DNA, 424 bp, Homo sapiens
  misc_feature: GZ8MTXP02IRFH3.22.29.C07.1.454.CMB.2.raw
  modified_base (421)..(424): a, c, t, g, unknown or other
  misc_feature (421)..(424): n is a, c, g, or t
tcagacatacgcgtcacgaccggtgctcgatttagagtgctacgaagggaaggggctggagtgggtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtgactacctactttctcgactggggccaggggaacccctggtcaccgtctcctcagcctccaccaaggccccatcggtcctccccctggcgccctgctcccaggagccacctccgagagcacagcggccccctgggctgcctggtcaaggctactccacgctatgtctgagcggctggcaaggcgcatagnnnn

SEQ ID NO: 333547 - DNA, 505 bp, Homo sapiens
  misc_feature: GZ8MTXP01EMWO8.51.60.F05.1.454.CMB.2.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (400)..(400): a, c, t, g, unknown or other
  misc_feature (400)..(400): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (484)..(484): a, c, t, g, unknown or other
  misc_feature (484)..(484): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctgganataaattgcgangataaatatgctgcctggatcagcagaagccaggcccagtcccctgtcgtgtcatctaatcaagacaccgaacgcgggaccctcgggggactaccgtgagtcgattctctcggctccaccgtactcggggaacacagccactctgaccagtccagcgggacgcaggcngtggatggaggcttgactttacngtcaggcgtgggcagcgcncgtggccggtgttcgggcggagggccgaggcctgaccgtccncgggtccaggcccaagggccc

SEQ ID NO: 333548 - DNA, 507 bp, Homo sapiens
  misc_feature: GZ8MTXP01AF30R.51.60.F05.1.454.CMB.2.raw
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctgtggtggtcatctatcaagacaccaagccggccctcggggactacccctggagcgattctctggcctcccacctcgtcggggaaccacacgcccactctagacccatcgagcgggacncgaggctgtggatggaggggctgtactttacgngtcgaggcgtgggacagcgacncgtgccgttggtcggcgagggaccagcttcgccgtcgcggtcacgcccaaggcctccg

SEQ ID NO: 333549 - DNA, 521 bp, Homo sapiens
  misc_feature: GZ8MTXP01D7JBK.51.60.F05.1.454.CMB.2.raw
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (424)..(424): a, c, t, g, unknown or other
  misc_feature (424)..(424): n is a, c, g, or t
tcagcgatcgtatacacgaccggtgctcgatttagtacgtcatcagggaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctgtggtggtcatctatcaagacaccaagcggccctcggggatacccctgagcgattctctggctccactctgggacacacncactctgacancgaggacgggacgcgaggcgtgtggagtggacggggtcttagttactttacgtgtcgnggtcggtacgggacgacgcgacgacgtcgtcggttcggtcgggcgggacgggaacgacgcgttcgtccgtccgtccgtcgacgaccgaacgcgtccg

SEQ ID NO: 333550 - DNA, 512 bp, Homo sapiens
  misc_feature: GZ8MTXP01DWEO1.51.60.F05.1.454.CMB.2.raw
  modified_base (200)..(200): a, c, t, g, unknown or other
  misc_feature (200)..(200): n is a, c, g, or t
  modified_base (389)..(389): a, c, t, g, unknown or other
  misc_feature (389)..(389): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaagccaggccagtcccctgtgtggtcatctatcaagacacaagcggcctcggggataccccgtgagcgtattctctggctcccacctcgtagggaaccacgacgcccactctgaccatcgagcgggacncgaggctgtgatgagggtctgtactttacgngtcgaggcgtggggactgcgacncgtgccggttgtcgggcggagggaccaagcttggaacccgtcgtcggtcacgcccgtaaggccgtcccg

SEQ ID NO: 333551 - DNA, 505 bp, Homo sapiens
  misc_feature: GZ8MTXP01ER9P7.51.60.F05.1.454.CMB.2.raw
  modified_base (199)..(199): a, c, t, g, unknown or other
  misc_feature (199)..(199): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctggagataaattgcgagataaatatgctgcctggatcagcaagaagccaggccagtcccctgtggtggtcatctatcaagacaccaagcggccctggggactacccctgagcgattctctggcctccacctctaggggaacacgagcccactctgaccatcagcgggacgcaggctgtggatgagggctgtactttangtcaggcgtgggacnggcgacatgccgttggttcggcgggagggaccaagcttaggaacccgtctcggtcacggcccaaggccgtccccgg

SEQ ID NO: 333552 - DNA, 512 bp, Homo sapiens
  misc_feature: GZ8MTXP01EW724.51.60.F05.1.454.CMB.2.raw
  modified_base (356)..(356): a, c, t, g, unknown or other
  misc_feature (356)..(356): n is a, c, g, or t
  modified_base (477)..(477): a, c, t, g, unknown or other
  misc_feature (477)..(477): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctgtgtggtcatctatcaagacaccaagcggcccctcgggggatacccctgagcgattctctgggctccacctctgggaacncagccactctgaccatcagccgggacgcgaggctgtggagtgaggggcttggtacttttactgtcgaggtcgtgggacgagcgacgactgccgttggtcgggttcggacggggaccaggcncggaaccgccgtcggtcacgcccaaggccgtcccg

SEQ ID NO: 333553 - DNA, 488 bp, Homo sapiens
  misc_feature: GZ8MTXP01DFE0G.51.60.F05.1.454.CMB.2.raw
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (411)..(411): a, c, t, g, unknown or other
  misc_feature (411)..(411): n is a, c, g, or t
  modified_base (473)..(473): a, c, t, g, unknown or other
  misc_feature (473)..(473): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggcagtcccctgtggtggtcatctatcaagacaccaagcggccctggggactacccctgagcgattctctggctccacctctggggaacncagccactctgaccatcagcgggacncaggctgtgatgaggggctgtaactttcngtcgaggcgtgggcagcgacactgcgttgttcggcggaggcagcttcgaaccgtctcggtcncgccaaggctcccgg

SEQ ID NO: 333554 - DNA, 494 bp, Homo sapiens
  misc_feature: GZ8MTXP01BA374.51.60.F05.1.454.CMB.2.raw
  modified_base (414)..(414): a, c, t, g, unknown or other
  misc_feature (414)..(414): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctgtggtggtcatctatcaagacaccaagcggccctcggggatacccctgagcgattctctggctccgacctctgggaacacagcccactctgaccatcagcgggacgcgaggctgtggatgaggggctggtactttacngtcaggcgtgggacaggcgacactggccgttgtcggcggagggccagcttgaaccgtcgcggtcagcccaaggcctcccg

SEQ ID NO: 333555 - DNA, 544 bp, Homo sapiens
  misc_feature: GZ8MTXP01DOEBZ.51.60.F05.1.454.CMB.2.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
  modified_base (418)..(418): a, c, t, g, unknown or other
  misc_feature (418)..(418): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaatgcgaagataaatatgctgcctggatcagcagaagccaggccagtcccctgtgtggtcatctatcaagacaccaagccggcctcggggataccccgtgagcgattctctggctccacctctgggaacncacgccactctgaccatcagcgggacgcgaggctagtggatggaggggcttgtactttacgngttcgagggcggtagggacagtcgacgacgtggtcccggttggttccgggcgggacgggaccgaacggccgttacggaacccgtcccgtccgggtccgacggccccgaacgggttccgtccccggg

SEQ ID NO: 333556 - DNA, 515 bp, Homo sapiens
  misc_feature: GZ8MTXP01AJEJ2.51.60.F05.1.454.CMB.2.raw
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctgtggtggtcatctatcaagacaccaagcggccctcggggataccccgtgagcgattctctcggctccacctcgtgggaacacacgccactctgaccatcacgcggacgcgaggctgtggatggaggggctgtacttttacgtgtccgaggcggtgggactagcgacgcgtgccgttggttcggcgggagggaccagcttcggaaccgtccgtcggtccacggcccaaggccgtccccgg

SEQ ID NO: 333557 - DNA, 531 bp, Homo sapiens
  misc_feature: GZ8MTXP01CNFJM.51.60.F05.1.454.CMB.2.raw
  modified_base (353)..(353): a, c, t, g, unknown or other
  misc_feature (353)..(353): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctgtggtggtcatctatcaagacaccaagcggcctcggggatacccctgagcgattctctggctccacctctgggaacncagcccactctgaccatcaagcgggacgcgggacgtgtggagtgagggacgtcgtaacgttttacgttcgtcgtacggcggttcggggcgacggtcggaccgacgtcggccggtcggttcgggtccgggagggaccgacgacgttcgacgtccgtcgtcgcgccgacgcgcgtccccg

SEQ ID NO: 333558 - DNA, 496 bp, Homo sapiens
  misc_feature: GZ8MTXP01D52TK.51.60.F05.1.454.CMB.2.raw
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (439)..(439): a, c, t, g, unknown or other
  misc_feature (439)..(439): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgcgagataaatatgctgcctggatcagcagaagccaggccagtcccctgtggtggtcatctatcaagacacaagcggcctcggggatacccctgagcgattctctggctccacctctacgggaacacagcccactctgaccatcgagcgggacncgaggcngtggatgaggggctggtactttacgtgtcgaggcgtgggcaggcgaaccncgtgcggttggtcggcggacggacagcgcgccgtcgtcgcacgccgtaacgcgtccg

SEQ ID NO: 333559 - DNA, 526 bp, Homo sapiens
  misc_feature: GZ8MTXP01DY6EQ.51.60.F05.1.454.CMB.2.raw
  modified_base (423)..(423): a, c, t, g, unknown or other
  misc_feature (423)..(423): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgaagataaatatgctgcctggatcagcagaagccaggccagtcccctgtggtggtcatctatcaagacaccaagccggccctcggggactaccccgtgagcgattctctggctccacctcgtagggaacacacgcccactctcgaccatcagacgggacgcgaggctgtggatggagggctggtacttttacngtcgaggcgtaggacagcgacacgtcgccgttggttcggcgggacggggaccaaggcgttacggaacccgtccgtcggtcacggcccgaacggccgtccccgg

SEQ ID NO: 333560 - DNA, 536 bp, Homo sapiens
  misc_feature: GZ8MTXP01CMTC9.51.60.F05.1.454.CMB.2.raw
  modified_base (200)..(200): a, c, t, g, unknown or other
  misc_feature (200)..(200): n is a, c, g, or t
  modified_base (435)..(435): a, c, t, g, unknown or other
  misc_feature (435)..(435): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggatcagcagaagccaggccagtcccctgtggtggtcatctatcaagacaccaagcggccctcgggggactacccccgtgagcgattccgtcttgggcctcccaaccgtcgtaggggaacacgagcccactctcgaccatcgaggcgggacgcgaggctgtggatggaggggtctggtactttacgngtcgaggcgtgggacagcgacncgtcgccggttggtcggnggacgggccaaggccttcggaacccggtccgttcggcgacgccccgaaggcccgtccccgg

SEQ ID NO: 333561 - DNA, 514 bp, Homo sapiens
  misc_feature: GZ8MTXP01B06QH.51.60.F05.1.454.CMB.2.raw
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (454)..(454): a, c, t, g, unknown or other
  misc_feature (454)..(454): n is a, c, g, or t
tcagcgatcgtatacacgaccggtgctcgatttagtacgtcatcagggaaaggggctgggcctcaggaagcagcatcgtaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgcgagataaatatgctgcctggatcagcagaagccaggccagtcccctgtggtggtcatctatcaagacaccaagcggcctcggggatacccctgagcgattctctggctccacctctgggaacacacgccactctgaccatcagcgggacgcagggctgtggatggaggggctggtactttacngtcgaggcgtgggacngcgacacgtggccgttgttccgggnggaacggggccaaggccttggaacccgtccgtcgggcaggccccgaagggccgtccccgg

SEQ ID NO: 333562 - DNA, 582 bp, Homo sapiens
  misc_feature: GZ8MTXP01DA9P2.51.60.F05.1.454.CMB.2.raw
  modified_base (421)..(421): a, c, t, g, unknown or other
  misc_feature (421)..(421): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaatgcgaagataaatatgctgcctggtatcagcagaagccaggccacgtcccctgtggtggtcatctatcaagacaccgaagccggcccgtcggggactaccccgtggagcgtattccgtctcggcctcccaccttcgtacgggaaccacgacgcccactctacgaccatcgaggcgggacgcgacgggcgtaggnggaagttggacggggtcgttaggtacttttacgtgtcgagggcggtaggggacaggccgactacgtcggtcccggttgggttccgggcgggaacggggaccaagggttcgttacggtaacccgtccgttccggcgacggaccccgaacgggcctccccggg

SEQ ID NO: 333563 - DNA, 526 bp, Homo sapiens
  misc_feature: GZ8MTXP01D30MK.51.60.F05.1.454.CMB.2.raw
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgcagataaatatgctgcctggtatcagcaagaagccaggccagtcccctgtggtggtcatctatcaagacaccaagccggcctcggggataccctgagcgattctctgctccacctctgggaacacagccactctgaccatcagagggacncgaggctagtggatggaggggctgactttacngtcaggcgtgggacaggcgacacgtgtccggttggttccgggcggaacgggggaccaaacggcgttacgggaacccgttccgttccgggcacggaccccgtaagggccgtccccgg

SEQ ID NO: 333564 - DNA, 555 bp, Homo sapiens
  misc_feature: GZ8MTXP01AMSG1.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaattgcgagataaatatgctgcctggatcagcagaagccaggccagtcccctgtggtggtcatctatcaagacaccaagcggccctcggggataccccgtgagcgattctctggcctccacctcgtacgggaacacagcccactctagacccatcgaggccgggacgcgagggctgtggatgagggggcttggtacttttacggngtcgnggcggtacggacnggccgacgcgtcggtccggttgggtcgggacgggaacgggaccgacggccgttaccggtaacccggtccgtccggtccgaccggacccgtaacggttcccgtcccgg

SEQ ID NO: 333565 - DNA, 522 bp, Homo sapiens
  misc_feature: GZ8MTXP01AZ8LG.51.60.F05.1.454.CMB.2.raw
  modified_base (199)..(199): a, c, t, g, unknown or other
  misc_feature (199)..(199): n is a, c, g, or t
  modified_base (321)..(321): a, c, t, g, unknown or other
  misc_feature (321)..(321): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (474)..(474): a, c, t, g, unknown or other
  misc_feature (474)..(474): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctggagataaattgcgagataaatatgctgcctggatcagcagaagccaggccagtcccctgtggtggtcatctatcaagacaccaagcggcctggggataccccngagcgattctctgggctcccacctctacggggaaccacacgcccactctacgacccagtccaggccggggaacgcgagggctggtggatggagggggctggtacttttacgngtcgaggcgtgggacngcgacncgtgccgttggttccgggnggacggggccaagcgttgaacctcgtcgcacgcccaagggcctcccgg

SEQ ID NO: 333566 - DNA, 490 bp, Homo sapiens
  misc_feature: GZ8MTXP01EBKCT.51.60.F05.1.454.CMB.2.raw
  modified_base (200)..(200): a, c, t, g, unknown or other
  misc_feature (200)..(200): n is a, c, g, or t
  modified_base (391)..(391): a, c, t, g, unknown or other
  misc_feature (391)..(391): n is a, c, g, or t
  modified_base (416)..(416): a, c, t, g, unknown or other
  misc_feature (416)..(416): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgaagataaatatgctgcctggatcagcagaagccaggccagtcccctgtggtggtcatctatcaagacaccaagcggccctcgggggatacccctgagcgattctctggctccacctctgggaacacagcccactctgaccatcagcgggacgcaggctgnggatgaggggctggtacttttacgngtcaggcgtagggcagcgacacgtgccgttgtcggcggagggcagcttgccgtcncggtcncgccaaggctccg

SEQ ID NO: 333567 - DNA, 517 bp, Homo sapiens
  misc_feature: GZ8MTXP01DGTUK.51.60.F05.1.454.CMB.2.raw
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgaagataaatatgctgacctggatcagcagaagccaggccagtcccctgtggtggtcatctatcaagacaccaagcggccctcggggataccccctgagcgtatctctggctacccacctctaggggaaccactacgcccactctcggaccatcgaagcgggacgcgaggcagtgatggaggctgtactttacgngttcagggtcgagggcaggcggtaaccncgtcggtcgttggtcgggcggacgggacagcgcggccgtcgtcgcacgaccgaacgccgtccg

SEQ ID NO: 333568 - DNA, 536 bp, Homo sapiens
  misc_feature: GZ8MTXP01BJTDD.51.60.F05.1.454.CMB.2.raw
  modified_base (409)..(409): a, c, t, g, unknown or other
  misc_feature (409)..(409): n is a, c, g, or t
  modified_base (463)..(463): a, c, t, g, unknown or other
  misc_feature (463)..(463): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctggtggtggtcatctatcaagacaccgaagccggcccgtcgggggataccccgtggagcgattctctgggcctcccacctcgtacgggaaccacacgcccactctcgaccatcgaggaccggggacgcgaggcngtggatggaggggcttggtacttttacgtgtccgagggcgtagggcaggcgacncgtgtcccgttggttcggcgggacgggaccaaggcttcgaacccgtcgcggtcacggcccaacggcgtcccgg

SEQ ID NO: 333569 - DNA, 551 bp, Homo sapiens
  misc_feature: GZ8MTXP01D6NQ0.51.60.F05.1.454.CMB.2.raw
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (521)..(521): a, c, t, g, unknown or other
  misc_feature (521)..(521): n is a, c, g, or t
  modified_base (543)..(543): a, c, t, g, unknown or other
  misc_feature (543)..(543): n is a, c, g, or t
tcagcgatcgtatacacgaccggtgctcgatttagtacgtcatcagggaagggctgggcctcaggaagcagcatcggaggtgcctcagccatggcatggatccctctcttcctcggcgtccttgcttactgcacaggatttgtggcctcctatgagctgattcagccaccctcagtgtccgtgtcccaaggacaaacagccagcatcacctgctctaggagtataaatgacgagtaataatatgctgcctggatcagcagagccaggccacgtccccgtggtggtgtctnctatacaacgacaccgaagccggcccgtacggggataccccgngagcgtattcgcctggcctccaccgtncgggacacgacncccactctacgaccagtccgaggacccggggacgcgagggctggaggatgggacgggttctaggtttcctagtcgtaggcgtaggcgtacgacgcgaccgtgcgtcggttacgggtcggttacgggacggacgaaccgttcgcggtccncggttccacggccacggcccgnggtccccg

SEQ ID NO: 333570 - DNA, 488 bp, Homo sapiens
  misc_feature: GZ8MTXP01AY1SF.51.60.F05.1.454.CMB.2.raw
  modified_base (324)..(324): a, c, t, g, unknown or other
  misc_feature (324)..(324): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtgtcatctatcaagacacaagcggcctcggggactaccccgngagcgatctctggctcacctctgggaacncagccactctgacatcagcggacncaggctggtgatggaggggctggtactttacgngtcgagcgtgggacagcgcngtgccgttgtcggnggacggaccagcttgaaccgtctcggtcacgccgaagcgtcccg

SEQ ID NO: 333571 - DNA, 512 bp, Homo sapiens
  misc_feature: GZ8MTXP01BVC6V.51.60.F05.1.454.CMB.2.raw
  modified_base (329)..(329): a, c, t, g, unknown or other
  misc_feature (329)..(329): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgacgagaataaatatgctgcctggatcagcaagaagccaggccagtcccctgtggtgtcatctatcaagacaccaagccggccctcggggactaccccgngagcgattctctggctccacctcgtagggaacacagcccatctgacatcagcgggacnaggcngtgatgaggctgtactttangtcaggcgtagggacnggcgacncgtgccgttggtcgggcggacgggaccaaggcttcggaacccgtccgtcgggtcacggcccaagggttcctccccgg

SEQ ID NO: 333572 - DNA, 583 bp, Homo sapiens
  misc_feature: GZ8MTXP01B3DW4.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (479)..(479): a, c, t, g, unknown or other
  misc_feature (479)..(479): n is a, c, g, or t
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaatgacgagataaatatgctgcctggtatcagcagaacgccaggccacgtcccctggtggtggtcatctatacaaagaccaccgaaagccggcccgtacgggggactacccccgtggacgccggtaactttcgtccgtcgggcccttcccgaacccgttcgtacggggaaaccacgaacgcccaactctacgaccactcgacgggcgggacgcgacgggctagtggagtggacggggtctagttacttttacgnggtcgagggcgtagggacnggcgacncgtcggccgttgggttcgggcgggacgggacgaagcgttcggaaccgtcccgcggtcacggcccgaacggctccccgg

SEQ ID NO: 333573 - DNA, 587 bp, Homo sapiens
  misc_feature: GZ8MTXP01ATNTT.51.60.F05.1.454.CMB.2.raw
  modified_base (200)..(200): a, c, t, g, unknown or other
  misc_feature (200)..(200): n is a, c, g, or t
  modified_base (413)..(413): a, c, t, g, unknown or other
  misc_feature (413)..(413): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggatcagcagaagccaggccagtcccctggtggtggtcatctatcaagaccaccgaagccggcccgtcgggggactaccccgtggagcgtattctctggcctcccacctcgtcgggaacacgacgcccacgtctgaccatcgaggcgggacgcgagggcttgggnggagtggacgggtcttacgttactttacgtgtcgtgggtcggtacgggacacggaccgacgcggtcggtccggttcgggtccggggacgggaacgggaaccgacggttccgttaccggtaaccccggttcccgtccggtaccgaccggacccggtaacggttccccgtccccgg

SEQ ID NO: 333574 - DNA, 587 bp, Homo sapiens
  misc_feature: GZ8MTXP01DMLDO.51.60.F05.1.454.CMB.2.raw
  modified_base (222)..(222): a, c, t, g, unknown or other
  misc_feature (222)..(222): n is a, c, g, or t
  modified_base (439)..(439): a, c, t, g, unknown or other
  misc_feature (439)..(439): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtcccgaggacaaacagccagcatcacctgctctgganataaattgacgaagataaatatgctagcctggatcagcagaagccaggccagtccccctggtggtggtcatctatcaagaccacaagccggccgtcggggactacccgtggagcgattctctggcctccacctcgtacggggaaccacacgccctactctacgaccatcgacggcgggacgcgaggctgtggatggaaggggcttagtactttacgngtcgaggcgtagggactaggcgtacgcgtaacggtccggttggttccggggaccgggaaacggggacccaaacgggttcttaccgggtaaccccgttccggtccggggtctaccgggttaccgaaccgggttcccgttaacccccggg

SEQ ID NO: 333575 - DNA, 583 bp, Homo sapiens
  misc_feature: GZ8MTXP01AUI1B.51.60.F05.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (425)..(425): a, c, t, g, unknown or other
  misc_feature (425)..(425): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcagtgtccgtgtccccaggacaaacngccagcatcacctgctctgganataatgcganataaanatgctgcctggtatcagcaagagccaggccagtcccctggtggtggtcatctatcaagaccaccgaacgccggccctcgggggactacccccgtggagcgtattccgtctcgggcctcccgacctcgtacgggaacacgacgcccactctacggacccagtccgaggccgggacgcgaggctggnggacgtgaggggtctaggttactttacgtgtccgtagggcggtagggactcggaccgaacgccgtcggtcccggttgggttcccgggcgggaacgggacccgaagcgttaccgaacccggttccgtcggtcgaccgttacccgaagcccgttccccgg

SEQ ID NO: 333576 - DNA, 626 bp, Homo sapiens
  misc_feature: GZ8MTXP01ENSYX.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaattgcgaagataaatatgctgcctggatcagcaagaacgccaggccagtcccctggtggtggtcatctatcaaagacaccaagccggcccgtcggggactaccccgtgagcgtattcctctcggcctcccaccctcgtacgggaaccacgacgcccactctacgacccagtccaggccgggacgccgagggctggtggaagtggagggggcttggttaacctttttacgtggttccgagggtcggttacgggggacacgggtaccgacgtaacggtcggtcccggttgggggttcccgggcggggaaccggggaacccgaagggttcccgttacggtaaccccgggttcccgtaaccgggttaccgaccgggaccccaaacggggttcccgtcccccggg

SEQ ID NO: 333577 - DNA, 515 bp, Homo sapiens
  misc_feature: GZ8MTXP01CB1P5.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (351)..(351): a, c, t, g, unknown or other
  misc_feature (351)..(351): n is a, c, g, or t
  modified_base (435)..(435): a, c, t, g, unknown or other
  misc_feature (435)..(435): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctctatgagctgattcagccaccctcagtgtccgtgtccccaggacaaacngccagcatcacctgctctgganataaatgcgagataaatatgctgcctggatcagcagaagccaggccagtcccctgtggtggtcatctatcaagacacaagcggcctcggggatacccctgagcgattctctggctccacctctgggaacncagcccactctgaccatcagcgggacgcgaggctgtggatcggaggggctgtactttactgtcgaggcgtagggacaggcgacncgtcgtccgttggttcgggcgggacgggaccgaacgcttcggaaccgtccgtcggtcgacgcccgaacggccgtccccgg

SEQ ID NO: 333578 - DNA, 558 bp, Homo sapiens
  misc_feature: GZ8MTXP01C9GY6.51.60.F05.1.454.CMB.2.raw
  modified_base (330)..(330): a, c, t, g, unknown or other
  misc_feature (330)..(330): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgacgagataaatatgctgcctggatcagcagagccaggccagtcccctggtggtggtcatctatcaagacaccgagccggacccgtggggactaccccgngagcgattcctctgggcctccaccctcgtacggggaaccacgtacgccccactctacggaacctagtaccgaggaccggggacgcgacgggcctggtaggatgggtaggggtcttaggttacttttacgngttcgnggcggtgggactggcgacgcgtgccggttggtccgggcgggacggaccgaggcttcggcccgtcgtcggtcacgacccgaagccgtccccgg

SEQ ID NO: 333579 - DNA, 563 bp, Homo sapiens
  misc_feature: GZ8MTXP01EETLZ.51.60.F05.1.454.CMB.2.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (343)..(343): a, c, t, g, unknown or other
  misc_feature (343)..(343): n is a, c, g, or t
  modified_base (377)..(377): a, c, t, g, unknown or other
  misc_feature (377)..(377): n is a, c, g, or t
  modified_base (454)..(454): a, c, t, g, unknown or other
  misc_feature (454)..(454): n is a, c, g, or t
  modified_base (470)..(470): a, c, t, g, unknown or other
  misc_feature (470)..(470): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctagganataaatgcgagataaatatgctgctggatcagcagagccaggccagtccctgtgngtcatctatcaaacgacaccgaaggccggccctacgggggactacccccgtggaagccgtattccnctcgggccttcccgaacctcgtgggaaccacganccccactccgtagacccagtccgaggccgggacgcagggctagtgggatgaggggcttaggtctttacgtggtacgngggtcggtagggaccngggacacgacgtcggtcggttcgggtcgggcggacgggaaccgagttcgacggtaaccgtccgtccggtcacggccctaacgggccgtcccgg

SEQ ID NO: 333580 - DNA, 527 bp, Homo sapiens
  misc_feature: GZ8MTXP01A46PC.51.60.F05.1.454.CMB.2.raw
  modified_base (355)..(355): a, c, t, g, unknown or other
  misc_feature (355)..(355): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagagccaggccagtcccctgtggtggtcatctatcaagacaccaagcggcctcggggatacccctgagcgattcctctggctccacctctgggaacncagcccactctgaccatcaggcgggacgcgaggctggtggatggaggggctggtacttttacgngtccgagggcgtaggggacaggcgaacncgtcggcccgttggtcgggcgggagggacccgaagccgttcgaacccggtcctcgggtcacgcccgaaggccgtccccgg

SEQ ID NO: 333581 - DNA, 549 bp, Homo sapiens
  misc_feature: GZ8MTXP01B0KS5.51.60.F05.1.454.CMB.2.raw
  modified_base (200)..(200): a, c, t, g, unknown or other
  misc_feature (200)..(200): n is a, c, g, or t
  modified_base (340)..(340): a, c, t, g, unknown or other
  misc_feature (340)..(340): n is a, c, g, or t
  modified_base (413)..(413): a, c, t, g, unknown or other
  misc_feature (413)..(413): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgacgagataaatatgctgcctggatcagcagagccaggccagtcccctgtggtgtcatctatcaaagaccacgaagccggcccgtcggggactaccccgtggagcgattcnctggccctccaccgtcgtacggggaaccacgacgcccaacgtctacggaaccagtaccgagggaccggggacncgagggcctggtggatggagggcttggttacttttacgngtcgaggcggtcggacgacgcgacncgtggccgttggtcggcgggaggaccagccgttaggaacccgtcgtcgtcgcggcccgtaacggcgtccccg

SEQ ID NO: 333582 - DNA, 489 bp, Homo sapiens
  misc_feature: GZ8MTXP01DCI20.51.60.F05.1.454.CMB.2.raw
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
  modified_base (477)..(477): a, c, t, g, unknown or other
  misc_feature (477)..(477): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgcgagataaatatgctgcctggatcagcagaagccaggccagtcccctgtggtggtcatctatcaagacaccaagccggccctcggggactaccccgtgagcgattctctggctccacctctcgggaacacagccactctcgaccatcagcgggacgcaggctgtggatggagggctgtactttacgngtcgaggcgtgggacagcgacnctgccgttgtcggnggaggcagcttgccgtcgcgtcngccaagcgtccg

SEQ ID NO: 333583 - DNA, 553 bp, Homo sapiens
  misc_feature: GZ8MTXP01D2515.51.60.F05.1.454.CMB.2.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
  modified_base (452)..(452): a, c, t, g, unknown or other
  misc_feature (452)..(452): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaatgngagataaatatgctgcctggatcagcaagaacgccaggccagtcccctgtggtggtcatctatcaagacacaagcgcctggggactaccctgagcgtattctctcggctcacctctacgggaacacgacgccactctacgaccatcgaggcgggacgcaggctgnggatggagggggcttgtacttttacngtcgagggccggttagggacctaggcgaacncgtcggccggttggttccgggcgggaacgggacccgaaaggccgttacggtaaccccggtccctcggggtaccacggaccccgaagggcccgtcccccggg

SEQ ID NO: 333584 - DNA, 502 bp, Homo sapiens
  misc_feature: GZ8MTXP01EMJCS.51.60.F05.1.454.CMB.2.raw
  modified_base (440)..(440): a, c, t, g, unknown or other
  misc_feature (440)..(440): n is a, c, g, or t
  modified_base (486)..(486): a, c, t, g, unknown or other
  misc_feature (486)..(486): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctgtggtggtcatctatcaagacaccaagcgccctcggggatacccctgagcgattctctggctccacctctgggaacacagcccactctgaccatcaggcgggacgcgaggctgtggatggaggggtcttggtacttttactgttcgaggcgtagggcagcgacnctgcgttggtcggcggagggaccaagcttggaaccgtcgtcggtcngcccaacggctcccgg

SEQ ID NO: 333585 - DNA, 628 bp, Homo sapiens
  misc_feature: GZ8MTXP01BVNP1.51.60.F05.1.454.CMB.2.raw
  modified_base (206)..(206): a, c, t, g, unknown or other
  misc_feature (206)..(206): n is a, c, g, or t
  modified_base (496)..(496): a, c, t, g, unknown or other
  misc_feature (496)..(496): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcgagtcgtccgtcgtccccgaggaaccaaacncgccagcatccacctgctcgtaggaataattaaagttgacgaagtaaattaaatatgctcgccgtggtatcagcaagaacgccgacggccacgtccccgtggtggtgtcatctatacaacgaccaccgaacggccggacccgtcggggactacccgtggacgcgtacttcgtcgtcggtcctacctaccgtcgtacgggaacacgacgaccctactcacgaccagtacgacgggacgggacgcgacgggcgtgggtaggagtggacgggtcgttaggtttacctttacgngtacgagggtccggtagggactggaccacgtcgtcggcccggttgggtccgggagggaccgggaacaaggttccgttaccggtaacccggtccgtaacggtccaccggacccggaacggttcccgtccccgg

SEQ ID NO: 333586 - DNA, 551 bp, Homo sapiens
  misc_feature: GZ8MTXP01CQ7P0.51.60.F05.1.454.CMB.2.raw
  modified_base (440)..(440): a, c, t, g, unknown or other
  misc_feature (440)..(440): n is a, c, g, or t
  modified_base (464)..(464): a, c, t, g, unknown or other
  misc_feature (464)..(464): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgacgagataaatatgctgcctggatcagcagaagccaggccagtcccctggtggtggtcatctatcaagacaccgaagccggcccgtggggactaccccgtggagcgtattcctctcggcctcccacctcgtagggaaccacacgcccactctcgaccatcaggccgggacgcgagggctggtggagtggaggggtctagtacttttacgngtcgaggcgtggggacaggcgacncgtcggccggttgggtccgggcgggaacgggcccaaggccgttcggaacccgtccgtcggtcaccggcccgtaacggccgtccccgg

SEQ ID NO: 333587 - DNA, 661 bp, Homo sapiens
  misc_feature: GZ8MTXP01BNSMC.51.60.F05.1.454.CMB.2.raw
tcagcgatcgtatacacgaccggtgctcgatttagtacgtcatcagggaaaggggcgtgggcctcaggaagcagcatcggaggtgcctcagccatggcatggatccctctcttcctcggcgtccttgcttactgcacaggatttgtggcctcctatgagctgattcagccacctcagtcgtccgtgtccccaggacaaacagccagcatcacctgctcgtggagataaattgcgagataaatatgctagcctggtatcgagcagtaacgccgaggcctacggtcccctggtcggtggtacatctatcaagaccacgaacgccggccgtacggggactaccccgtggacgcgtaacttcgtcgtcggcctcccacctcgtacgggaacacgacgcccactcgtacgaccagtcacggacgggacgtcgacgggcttgggtacggtagtggaacggggtcttaggttaacctttttacgtcggttcgaggggtccgggttagggacgtaccgggaccgtacccggtaaccggtcgggtcccgggtttcgggttccggggccgggtaacggggacccgttaaacggttccgttaccgggtaaccccggtcccggttaaccgggaccgaccgggttaccccggaacgggttccccgttccccggg

SEQ ID NO: 333588 - DNA, 578 bp, Homo sapiens
  misc_feature: GZ8MTXP01EBY64.51.60.F05.1.454.CMB.2.raw
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (337)..(337): a, c, t, g, unknown or other
  misc_feature (337)..(337): n is a, c, g, or t
  modified_base (457)..(457): a, c, t, g, unknown or other
  misc_feature (457)..(457): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacagccagcatcacctgctntgganataaattgacgaagaataaatatgctgcctggatcagcagaagccaggccagtcccctggtggtggtcatctatacaacgacaccgaagccggcccgtcggggactaccccgngagcgtacttcgtctcggcctccgacctcgtacgggaaccacgacgacccactctacgaccatcgacggacggggacgcgaggctggtggagtggaggggtcgttggttaccttttacgngttccgaggtcggtaggacgtaggccgacgcgtggtccggttggttcggggacgggacgggaccgaggttcgacggtaacccgtccgtccggacacggacccgaacggcccgttccccggg

SEQ ID NO: 333589 - DNA, 504 bp, Homo sapiens
  misc_feature: GZ8MTXP01B9ZIC.51.60.F05.1.454.CMB.2.raw
  modified_base (224)..(224): a, c, t, g, unknown or other
  misc_feature (224)..(224): n is a, c, g, or t
  modified_base (334)..(334): a, c, t, g, unknown or other
  misc_feature (334)..(334): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacaggccagcatcaccgtgctctgganataaattgcgagataaatatgctgcctggatcagcagaagccaggccagtcccctggtggtggtcatctatcaagacacaagcgcctcggggatacccctgagcgattcnctaggctcacctcgcgggaacacagccactcnaccatcagcgggacnctggngngngagngngggcgtgtacgttacgtcgtcgcggcggtcggcgtacgcgcgcgtcgtcggttcggtcggcgggacggacgacgcgcgtccgtccgtcgcgcgaccgtaacgcgtccg

SEQ ID NO: 333590 - DNA, 569 bp, Homo sapiens
  misc_feature: GZ8MTXP01BVQZE.51.60.F05.1.454.CMB.2.raw
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (466)..(466): a, c, t, g, unknown or other
  misc_feature (466)..(466): n is a, c, g, or t
  modified_base (520)..(520): a, c, t, g, unknown or other
  misc_feature (520)..(520): n is a, c, g, or t
  modified_base (548)..(548): a, c, t, g, unknown or other
  misc_feature (548)..(548): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagcccaccctcgagtcgtccgtcgtccccgaggaaccaaacncgccagcatccacctgctcgtgganaattaatgacgagtaataaatatgctgcctggtactcgagcaagacgccgaggccacgtccccgtgtggtgtcatctatcaaacgccaaccgaggcccggcccgtaggggactaccccgtggacgcgtattcctcgcgcctcccactcggtagggaaccacacgccctatctacgacctagcgaggccgggacncgacggcgtgnggatggcggggtacttggttacttttacgnggtccgaggggtcgtagggacacgtaccgacacgtcggtccgttgggtccgggnggtacggcagcttacgcccgtcgtccgnccgacccgtaaggcctcccgg

SEQ ID NO: 333591 - DNA, 720 bp, Homo sapiens
  misc_feature: GZ8MTXP01A5WHH.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtcgtccgtgtccccaggacaaacagccagcatcacctgctctgagataaattgacgagataaatatgctgcctggatcagcaagaacgccgacggccacgtccccgtggtcggtggtcagtctatacaaacgaaccaccgaaaggcccggacccgtacggggactacccccgtggacgtacgtattccgtacgtcggtccctaccctacccgtacggtacggggaaaccacgaaccgccccaacctttccgacgaacccagtaccgaacggggacccggggaacgcggaacgggtccgtgggttagggaagttcgggaacggggtttccgttacggggtttaaccttttttaaccggtggttacccggaaggggtcgggttaacggggaccgtacggacccgtaccgaccggttcgggtccccggtttgggggttacccggggcggggaaacgggtaacccgaacggttccggttaccggtaaccccggttccggtccgggtaccgaccggttaccccggaacgggttccccgttcccccggg

SEQ ID NO: 333592 - DNA, 590 bp, Homo sapiens
  misc_feature: GZ8MTXP01BIJE0.51.60.F05.1.454.CMB.2.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagccaccctcagtcgtccgtcgtccccaggacaaacngccagcatcacctgctctagganataaattgacgagaataaatatgctgcctggatcagcagaagccaggccacgtccccgtggtggtggtcatctatacaagacaccgaagcggcccgtcggggactaccccgtggagcgacttctctcggcctccacctcgtacgggaacacacgcccactctacgaccatccgacggccgggaacgccgaggccgtgtggatggagggtcgtacgttacctttcgtcgtcgacgggtcggtacgggacgtacggaccgaacgcgtcggcccgggttagggttccggggacgggaacggggaccaacggcgttacgtaacccggtccgttaacggccgacggacccgaacgggcccgtccccggg

SEQ ID NO: 333593 - DNA, 521 bp, Homo sapiens
  misc_feature: GZ8MTXP01CR4UZ.51.60.F05.1.454.CMB.2.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggatcagcagaagccaggccagtcccctgngtggtcatcatcaagacacaagcggcctcggggatacccctgagcgattctctggcctcccacctacgtcgggaaacacacgcccactctcgaccatcaggcgggacgcaggctgtggagtcggagggtctggtactttacgngtcgaggcgtagggcagcgacncgngtccggttggttcggcggaagggcccaagttcgcgaacccgtccgtcggtcgacgcccgtaaggccgtccccgg

SEQ ID NO: 333594 - DNA, 547 bp, Homo sapiens
  misc_feature: GZ8MTXP01A599L.51.60.F05.1.454.CMB.2.raw
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaatgcgagataaatatgctgctggatcagcagaagccaggccacgtcccctgtggtggtcatctatcaagacaccagccgcctcggggactaccccgtgagcgtattctctcggctcccaccgtcgtacgggaacacacgcccactctacgaccatccgaggaccggggacgcgacgggctggtggagtggaggggtcttgtacttttacgtgtccgaggtcgtgggacnggcgacncgtcgccggttggtccgggcgggacgggaccgaaggcgttacggaacccgtcgtccggtcacggcccgaacggttccgtccccgg

SEQ ID NO: 333595 - DNA, 556 bp, Homo sapiens
  misc_feature: GZ8MTXP01B60L2.51.60.F05.1.454.CMB.2.raw
  modified_base (477)..(477): a, c, t, g, unknown or other
  misc_feature (477)..(477): n is a, c, g, or t
  modified_base (496)..(496): a, c, t, g, unknown or other
  misc_feature (496)..(496): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgcgagataaatatgctgcctggatcagcagaagccaggccagtcccctggtggtggtcatctatcaagacaccgaagccggcccgtcgggggactaccccgtggagcgtattctcgtcggcctccacctcgtacggggaaccacgacgcccactctacggaccatccgagggccggggacgcgagggctggtggagttggaggggtcttgttacttttacgtgtccgagggcgtgggacaggcgacncgtgccggttgggtccggngggtacgggaccaggcttcggaacccgtccgtcggtcgacgcccgaacggccgtccccgg

SEQ ID NO: 333596 - DNA, 528 bp, Homo sapiens
  misc_feature: GZ8MTXP01AZYPH.51.60.F05.1.454.CMB.2.raw
  modified_base (200)..(200): a, c, t, g, unknown or other
  misc_feature (200)..(200): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggatcagcagaagccaggccagtcccctgtggtggtcatctatcaagacaccaagccggcctcggggatacccctgagcgattctctggctccacctctagggaacacacgcccactctcgaccatcagcgggacncaggctgtgatggaggggtctggttactttacngtccgaggcgtaggggcaggcgacacgtcggccgttggttcgggcgggacgggaccaaggccttcggaacccgttccgtcgggtccacggaccccgaaggccgtccccggg

SEQ ID NO: 333597 - DNA, 697 bp, Homo sapiens
  misc_feature: GZ8MTXP01BS3OL.51.60.F05.1.454.CMB.2.raw
  modified_base (205)..(205): a, c, t, g, unknown or other
  misc_feature (205)..(205): n is a, c, g, or t
  modified_base (618)..(618): a, c, t, g, unknown or other
  misc_feature (618)..(618): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcgagtcgtccgtcgtcccgaggaacaaacncgccagcatccacctgctcgtaggataattaaatgacgaagtaattaaatgtgctcgccgttaggtactcgagacgaagaacgccgacggaccctaccggtccccgttggtcggtggtactactactactacaaacgacaaccgacggccggaccgtagggactacccgtggacgtcgtacttcctcgtccggtccctacccgtacccgtacgggtaaccggaaccaacgaccgaccctactcgtacggaaccctagaccggacggggacccggggacacggcgggtcgaggggttacgagtacgggaccggggttcttaacgggttttaccttttacggcggttaccggagggtccgggtaacgggactacggcgtaaaccgtcgtccggtaccgggttgggtacccggggnggaacgggaaccttacggttcgttacccggtaacccgtcgtaacggtaccgacggacccgtaaggttccccgtccccgg

SEQ ID NO: 333598 - DNA, 584 bp, Homo sapiens
  misc_feature: GZ8MTXP01DPW0E.51.60.F05.1.454.CMB.2.raw
  modified_base (222)..(222): a, c, t, g, unknown or other
  misc_feature (222)..(222): n is a, c, g, or t
  modified_base (473)..(473): a, c, t, g, unknown or other
  misc_feature (473)..(473): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgacgagataaatatgctgcctggtatcagcaagaagccaggccacgtcccctggtggtggtcatctatcaagacaccaagccggcccgtcggggactaccccgtggagcgtattcctctcggcctccacctcgtacggggaaccacgacgcccactctacgaccatcgaggccgggacgcgacggctggtggagtggacggggtcttacggttacttttacgtggtcgagggcggtaggggacncggcgacgcgtcggccggttgggttccgggcgggtaacgggacccgaacggttccgttaccggtaacccgtccgtccgggtccgacggccccgaacggttcccgtccccgg

SEQ ID NO: 333599 - DNA, 561 bp, Homo sapiens
  misc_feature: GZ8MTXP01EAYGS.51.60.F05.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcacctgctctgganataaatgacgagataaatatgctgcctggatcagcaagaagccaggccacgtcccctgtggtggtcatctatacaacgacaccgaagccggcccgtcgggggactaccccgtggagcgtattctcgtggcctccacctcgtcgggaacacacgcccactcgtcgaccatcgagcgggacncgaggctggnggatggacgggtcgttagttacgttttacgtggtcgagggtcggtagggactcggcgacacgtcgccggttcggttcgggacgggacgggaccaaggccttcggaacccgtccgtcggtcgcgttacccgaacggttccgtccccgg

SEQ ID NO: 333600 - DNA, 570 bp, Homo sapiens
  misc_feature: GZ8MTXP01D4RCO.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (350)..(350): a, c, t, g, unknown or other
  misc_feature (350)..(350): n is a, c, g, or t
  modified_base (412)..(412): a, c, t, g, unknown or other
  misc_feature (412)..(412): n is a, c, g, or t
  modified_base (451)..(451): a, c, t, g, unknown or other
  misc_feature (451)..(451): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtcgtccgtgtccccaggacaaacngccagcatcacctgctctgganataaatgacgagaataaatatgctgcctggtatcagcaagaacgccaggccacgtcccctggtggtgtcatctatacaagacaaccgaacgccggcccgtacggggactacccgtgagcgtacttcncgtcggcctccacctcgtacgggaacacgacgcccactcgtacgaccatcgacggcgggacncgaggcgtgtgagtggacggggtcttggttactttacgngtcgaggcggtaggactggacgacgtcgtcggtcggttgggtccgggacggaacgggaccaacggttcgttacggtaacccgtccgtcggccgacggacccgtaacggcccgtccccgg

SEQ ID NO: 333601 - DNA, 692 bp, Homo sapiens
  misc_feature: GZ8MTXP01BIA7E.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaatgacgagataaatatgctgcctggtatcagcagaacgccgacggccacgtcccctggtcggtggtctatctatacgaacgaccaccgaaggccggacccgtcggggactaccccgtggacgtcgtattccgtcgtcggtcctcccgtaccgtcgtacgggaaccacgacgccctactccgtcgaccgagtccgacggaccggggacgacgacgggcgtggtaggagtggacggggtcgttacgtttaaccgttttacgtcggtccggacgggtcgggttacgggaccgtacggacccgtaaccgtccggtcggtcccggggttggggttcccgggggaccggggtaacgggggaaaccccggttaacggttcccgggttaccggtaacccccgggttcccggtaacccgggttacccggacccggttacccccgggtaaacgggttccccggtttccccccggg

SEQ ID NO: 333602 - DNA, 591 bp, Homo sapiens
  misc_feature: GZ8MTXP01B23CZ.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (453)..(453): a, c, t, g, unknown or other
  misc_feature (453)..(453): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaattgcgagataaatatgctgcctggatcagcaagaagccaggccagtcccctgtggtgtcatctatcaaagacaccgaagccggcccgtcggggactaccccgtggagcgtattctctcggcctcccacctcgtacgggaaccacgacgcccactctacgaaccataccgagggaccgggacgcgacgggctggtggagtgacggggtcttcggtaaccttttacgnggttcgacggggtcggtacgggactacggcgacgtacgtcggcccggttgggtccgggacgggaacgggaccgacggccgttacggtaacccgtccggtccggtaccgacggaccccgtaacggttcccgtccccggg

SEQ ID NO: 333603 - DNA, 643 bp, Homo sapiens
  misc_feature: GZ8MTXP01DBFNM.51.60.F05.1.454.CMB.2.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (395)..(395): a, c, t, g, unknown or other
  misc_feature (395)..(395): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtgtccgtgtccccaggacaaacngccagcatcactgctntganataatgcgaagataaatatgctgcctggtatcgagcaagaacgccaggccacgtcccctggtcggtggtcattctatacaaacgaccaaccgaaggccggacccgtacgggggactacccccgtggacgtcgtattcctcgttacggccctccctaccgtcgtacggggaaaccncgacgccctactcgtacgaaccagtccgacggccgggacgcgacgggtctggtaggagtgggacggggtcttaggttaccttttacgtcggttacgacgggtccggtagggaacgtaggacccggaacgtcgtcgggtccgggttgggttacccggggacgggtaacggggaaccaagggttccgttccgggtaacccggttccgttcgggacccacggttacccggaacgggccccgtaaccccggg

SEQ ID NO: 333604 - DNA, 498 bp, Homo sapiens
  misc_feature: GZ8MTXP01EBZR3.51.60.F05.1.454.CMB.2.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
  modified_base (477)..(477): a, c, t, g, unknown or other
  misc_feature (477)..(477): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctcnggagataaattgcgagataaatatgctgcctggatcagcaagaagccaggccagtcccctgtggtgtcatctatcaagacaccagcggcctcggggatacccgtgagcattctctggctccacctctcgggaacacacgcccactctgaccatcagcgggacgcaggctgnggatgagggctgtactttagngtcgaggcgtgggacagcgacgctggcgttggttcggcggacggcgagcgttcgccgtcgcggtcncggcccgaacgccgtccccgg

SEQ ID NO: 333605 - DNA, 610 bp, Homo sapiens
  misc_feature: GZ8MTXP01A7E8G.51.60.F05.1.454.CMB.2.raw
  modified_base (204)..(204): a, c, t, g, unknown or other
  misc_feature (204)..(204): n is a, c, g, or t
  modified_base (489)..(489): a, c, t, g, unknown or other
  misc_feature (489)..(489): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcagtcgtccgtcgtccccaggacaaacngccagcatcacctgctcgtaggagataaattgacgaagtaataaatatgctgcctggtatcagcaagacgccgacggcctacgtcccctggtcggtggtcatctactacaaacgaccaccgaaggcccggccgtcggggactacccgtggagcgtattcctcgtcggtcctacccaccgtcgtacgggaaccacgacgtcccactcgtacgaccagtacgacgggaccggggacgtcgacgggtcgtggtaggagtcggagggggtcgttacggttactttacgnggtaccgaggtcggtagggacaggtccgactggtcgtccggttcgggtcgggacgggacggaccgacggcgttcggaacccgtcgtcggccgacggttacccgaacggttcccgtccccgg

SEQ ID NO: 333606 - DNA, 511 bp, Homo sapiens
  misc_feature: GZ8MTXP01EAT09.51.60.F05.1.454.CMB.2.raw
  modified_base (339)..(339): a, c, t, g, unknown or other
  misc_feature (339)..(339): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaaattgcgagataaaatatgctgcctggatcagcagaagccaggccagtcccctgtggtggtcatctatcaaagacaccaaagcggccctcgggggatacccctgagcgattcnctggctcacctctgggaacacagccactctgaccatcaagcgggacgcaggctgtggatgaggggctgactttactgtnagggngtggacgagcgacactcgtcggttcggtcgggcgggacgggaacgaacgcgttcgccgtccgtccggtcgacgaccgaacggcgtccg

SEQ ID NO: 333607 - DNA, 585 bp, Homo sapiens
  misc_feature: GZ8MTXP01EHL4Y.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (412)..(412): a, c, t, g, unknown or other
  misc_feature (412)..(412): n is a, c, g, or t
  modified_base (479)..(479): a, c, t, g, unknown or other
  misc_feature (479)..(479): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaattgcgaagataaatatgctgcctggatcagcagagccaggccacgtcccctggtggtggtcatctatcaagacaccaagccggcccgtggggactaccccgtgacgcgtacttctcgtcggcctccacctcgtacgggaacacgacgcccactctcgaccatcgaggccgggacgcgaggctgnggatcggacggggtcttggttacctttttacgcgttcgacgggtcggtagggactacggccgaaccncgtcggtccggttcggggttccgggacgggacgggacccgaggttcccgttacggtaaccccggtcggtccggtacgaccggacccgtaacgggttccctccccgg

SEQ ID NO: 333608 - DNA, 626 bp, Homo sapiens
  misc_feature: GZ8MTXP01B0DP5.51.60.F05.1.454.CMB.2.raw
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcactgctctgganataaattgacgagaataaatatgctgcctggtatcagcagacgccaggccagtcccctggtcggtggtcagtctatcaaagacaaccgagccggccgtcggggactacccgtgagtcgtacttcgtctcgggcctccgtacccgtcgtacggggaaacctacgacgtccccaacttccgtacggaacccagtaccgaacgggccggggacgccgacgggtccgttgggtggacgtgggacggggtcttacggttacttttacgtcggttcgacgggtcggtacgggacgtaggacccgtaccgacgtcggtcccgggttggttaccgggcgggtaacgggaccacggttcgttaccggaacccgttccgcggtccgcgttacccgaacggttcccgtccccgg

SEQ ID NO: 333609 - DNA, 598 bp, Homo sapiens
  misc_feature: GZ8MTXP01EEONG.51.60.F05.1.454.CMB.2.raw
  modified_base (222)..(222): a, c, t, g, unknown or other
  misc_feature (222)..(222): n is a, c, g, or t
  modified_base (378)..(378): a, c, t, g, unknown or other
  misc_feature (378)..(378): n is a, c, g, or t
  modified_base (456)..(456): a, c, t, g, unknown or other
  misc_feature (456)..(456): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaatgacgagataaatatgctgcctggtatcagcagaacgccaggccagtcccctggtggtgtcatctatcaaagacaccgaagccggcccgtacggggactacccccgtgacgcgtacttctcgtcggcctcccgacctcgtacgggaaaccncgacgcccactctacgaccagtccgaggccgggacgcgaggctggtaggagtggaggggtcttagttaccttttacgngtcgagggtcggtaggggactaggccgactacggtcggtccggttgggttccgggacgggacgggaacccaacggttccgttacgggtaaccccgttccgtccgggtcaccggaccccgtaacgggttcccgttcccccggg

SEQ ID NO: 333610 - DNA, 569 bp, Homo sapiens
  misc_feature: GZ8MTXP01AS4HI.51.60.F05.1.454.CMB.2.raw
  modified_base (200)..(200): a, c, t, g, unknown or other
  misc_feature (200)..(200): n is a, c, g, or t
  modified_base (434)..(434): a, c, t, g, unknown or other
  misc_feature (434)..(434): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggatcagcagagccaggccagtcccctgtggtggtcatctatcaagacacagcgccgtcgggataccctgagcgattctcgtggcctccacccgtcgtacgggaacacacgccctactctacggacccataccgaggccggggaacgcgagggctaggtggagtggagggtctggtacttttacgngtcgaggcggtgggacaggcgaacgcgtcggcccggttggttacccggggcgggaaacggggtacccaaaggttcccgttacgggaaccccggtcgtcccgggtccacggacccccgaagggttcccgtccccgg

SEQ ID NO: 333611 - DNA, 501 bp, Homo sapiens
  misc_feature: GZ8MTXP01EHL37.51.60.F05.1.454.CMB.2.raw
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggatcagcagaagccaggccagtcccctgtggtggtcatctatcaagacaccaagccggcctcggggataccccgtgagcgattctctggctccacctcgtgggaacacagcccactctgaccatcaggcgggacgcagggctgtgatgaggggctggtacttttacngtcaggcgtaggggcngcgacncgtgccgttgtcggcggagggaccagcgttgaaccgtcgcggtcacgcccaagggctcccgg

SEQ ID NO: 333612 - DNA, 527 bp, Homo sapiens
  misc_feature: GZ8MTXP01DAZYA.51.60.F05.1.454.CMB.2.raw
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcaagataaatatgctgcctggatcagcagaagccaggccagtcccctgtgtggtcatctatcaagacaccaagcggccctcgggggactacccccgtggagcgattctctggcctccaaccctcgtaggggaaccacgtagcccactctcgaccatcagcgggacgcaggcngtgatgagggcttgtactttacgngtccgaggcgtagggacnggcgacgacgtgccggttggttcggcgggacgggaccaaggcttcggaacccgtcctcgggcacggcccaagggcctccccgg

SEQ ID NO: 333613 - DNA, 548 bp, Homo sapiens
  misc_feature: GZ8MTXP01C8PX9.51.60.F05.1.454.CMB.2.raw
  modified_base (222)..(222): a, c, t, g, unknown or other
  misc_feature (222)..(222): n is a, c, g, or t
  modified_base (397)..(397): a, c, t, g, unknown or other
  misc_feature (397)..(397): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaatgcgaagataaatatgctgcctgatcagcagaagcagccacgtcccctgtgtgtcatcatcaagacaccaagtcggccgtggggataccccgtgagcgattctctacgggctacccacctacgtacgggaaaccacacgcccaactctacgacccatcgacggcgggacncgaggctgtggatggagggccgttgtactttacgtgtcgaggcggtaggactaggcgactcgtcgtccggttgggtcgggcgggtaacgggaccaaacggttcgacggaacccgttccgtcgtcgaccgacccgtaacggccgtcccccgg

SEQ ID NO: 333614 - DNA, 576 bp, Homo sapiens
  misc_feature: GZ8MTXP01AWK4V.51.60.F05.1.454.CMB.2.raw
  modified_base (200)..(200): a, c, t, g, unknown or other
  misc_feature (200)..(200): n is a, c, g, or t
  modified_base (396)..(396): a, c, t, g, unknown or other
  misc_feature (396)..(396): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggatcagcagaacgccaggccagtcccctggtggtgtcatctatcaagaccaccgaagccggcccgtcggggactaccccgtggacgcgtacttctcgtcggcctccgaccctcgtacgggaaccacgacgcccactctacgaccancgacggcgggacgcgaggcgtgtggagtggacggggtcttggttaccttttacgcgttcgacgggcggtagggactcggcgacgcgtcggccggttggtccgggacgggtacgggacccgaacggccgttacggtaacccgtccgtcgggtcgaccggcccgaacgggttccgtccccgg

SEQ ID NO: 333615 - DNA, 565 bp, Homo sapiens
  misc_feature: GZ8MTXP01ERVFS.51.60.F05.1.454.CMB.2.raw
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (456)..(456): a, c, t, g, unknown or other
  misc_feature (456)..(456): n is a, c, g, or t
  modified_base (487)..(487): a, c, t, g, unknown or other
  misc_feature (487)..(487): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtcgtccccaggacaaacngccagcatcacctgctctgganataattgacgagataaatatgctgcctggatcagcaagacgccaggccagtcccctgtggtgtcatctatcaagacaccaagccgccgtcgggactacccctggacgcgtattcctcgtcgggcctcccaccgttccgtaggggaaaccacgacgcccactcctagaccagtcgacggaccgggacgacgagggcgtggtggagtggaggggtcttagttacgttttacgnggttccgagggtccggtagggacaggcgacncgtcggtccgttgggtcgggcggacgggacgaagttcgacgtaaccgtcccgtcgcgcgaccgtaacggcgtccccgg

SEQ ID NO: 333616 - DNA, 540 bp, Homo sapiens
  misc_feature: GZ8MTXP01EYRPM.51.60.F05.1.454.CMB.2.raw
  modified_base (429)..(429): a, c, t, g, unknown or other
  misc_feature (429)..(429): n is a, c, g, or t
  modified_base (454)..(454): a, c, t, g, unknown or other
  misc_feature (454)..(454): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaatgacgagataaatatgctgcctggatcagcagaagccaggccagtcccctggtggtggcatctatcaagacaccgaagccggcccgtcggggataccccgtgagcgattctctcggcctcccacctcgtagggaaccacgacgcccactctacgaccatcgaggcggacgcgaggctgtggatgagggtctgtactttacgngtcgaggcgtagggacaggccgacncgtgtcccggttggtcgggcggaagggaccaaggcgttacggcccggtccgtcgggtccacggacccgaacgggttcccgtcccgg

SEQ ID NO: 333617 - DNA, 627 bp, Homo sapiens
  misc_feature: GZ8MTXP01A3MFN.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaattgacgagaataaatatgctgcctggatcagcagaacgccaggccagtcccctggtggtcggtcatctatcaaagaccaccgaagccgccgtcggggactacccgtgagcgtattctctcggcctccaccgtcgtacgggaaccacgacgcccactcgtacgaccatccgacgggccgggacgcgagggtacgtggtacggagttggacggggttcgtagttactttacgtggtccgagggtcggtacggggactacggcgtaacgccgtcggtccgggttcgggttccggggacggggtaacggggtaacccgaacgggttcccggttacccgggtaaccccgttcccggtccgggtacccgaccggacccccggaacgggttccccgttccccccggg

SEQ ID NO: 333618 - DNA, 601 bp, Homo sapiens
  misc_feature: GZ8MTXP01BV8M2.51.60.F05.1.454.CMB.2.raw
  modified_base (264)..(264): a, c, t, g, unknown or other
  misc_feature (264)..(264): n is a, c, g, or t
  modified_base (409)..(409): a, c, t, g, unknown or other
  misc_feature (409)..(409): n is a, c, g, or t
  modified_base (450)..(450): a, c, t, g, unknown or other
  misc_feature (450)..(450): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgacgagaataaatatgctgcctggtatcagcagaanccaggccagtcccctggtggtgtcatctatcaaagacaccgaaggccggccgtacggggactaccccgtgacgcgtattctctcggcctccacctcgtacgggaaccacgacgcccactctacgaccagtccgagggcgggacgngacgggcttggaggatggaggggtcttcggtacttttacgngtcgagggtcggtacgggacaaggccgtaacgccggtcggtccgggttgggttaccggggcggggtaacgggacccaaagggttcccgttacgggtaaccccggtccgtccggggtaccaccgggaccccgaaggttcccgttcccccggg

SEQ ID NO: 333619 - DNA, 585 bp, Homo sapiens
  misc_feature: GZ8MTXP01EE7DL.51.60.F05.1.454.CMB.2.raw
  modified_base (334)..(334): a, c, t, g, unknown or other
  misc_feature (334)..(334): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (485)..(485): a, c, t, g, unknown or other
  misc_feature (485)..(485): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtgtccgtgtccccaggacaaacagccagcatcacctgctctggagataaattgcgagataaatatgctgcctggtatcagcaagaagccaggccacgtcccctggtggtgtcatctatcaacgacaccaaggccggcccgtacggggactaccccgnggagcgtattctacgtcggcctcccaccgtcgtacgggaaccacacgcccactctacgaccatcgacggcggggacgngagggctggnggagtggacggggtcttagttaccttttacgtcgtcgacggcgggtaggggactcggcgaacncgtcggtccggttcggtcggggacgggaacggggaccaggttccgttcgggtaacccgtccggttcggccgaccggacccgaacgggttcccgtccccgg

SEQ ID NO: 333620 - DNA, 493 bp, Homo sapiens
  misc_feature: GZ8MTXP01EHMHR.51.60.F05.1.454.CMB.2.raw
  modified_base (388)..(388): a, c, t, g, unknown or other
  misc_feature (388)..(388): n is a, c, g, or t
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgcgagataaatatgctgcctggatcagcagaagccaggccagtcccctgtggtggtcatctatcaagacaccaagcggccctcgggggatacccctgagcgattctctggctccacctctgggaacacagccactctgaccatcagcgggacgcaggctgnggatgaggggctggtacttttacngtcgaggcgtagggcagcgacncgtgccgttgtcggcggagggccaagcttgaaccgtctcggtcagcccaaggctcccgg

SEQ ID NO: 333621 - DNA, 631 bp, Homo sapiens
  misc_feature: GZ8MTXP01B59X2.51.60.F05.1.454.CMB.2.raw
  modified_base (203)..(203): a, c, t, g, unknown or other
  misc_feature (203)..(203): n is a, c, g, or t
  modified_base (493)..(493): a, c, t, g, unknown or other
  misc_feature (493)..(493): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccacctcagtcgtccgtcgtccccaggacaaacngccagcatcactgctcgtggagataattgacgagaataaatatgctgcctggatcagcagacgccgacggccacgtccccgtggtggtcgtcatctatacaaacgaccaaccgaacggcccggtcccggtacggggactacccccgtggacgtcgtacttccgtcgtcggtccctacccgtacccgtcggtacgggaacctacgacgaccctactctacgaccagtccgacgggaccgggacgcgagggtcgtggaggtacgtggacgggtcgttacggttactttacgngttacgagggtcggtaggactacggcgacgtcgtcgggtcggttcgggtccgggacgggaacggtaccgacggttcgttaccggtaacccggttccgtccggaccgaccggaccccggtaacggttcccgtcccccgg

SEQ ID NO: 333622 - DNA, 648 bp, Homo sapiens
  misc_feature: GZ8MTXP01BTPYB.51.60.F05.1.454.CMB.2.raw
  modified_base (200)..(200): a, c, t, g, unknown or other
  misc_feature (200)..(200): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggatcagcagagccaggccagtcccctgtggtggtcatctatacaagacaccgaagccggcccgtcggggactaccccgtggagcgtattcgtctgggcctccgacctcgtacgggaaccacacgccctactctacggacctacgtacgacgggaccggggacgcgtacggggcttgggtggtaagttgggaacgggggtctttacgggttaacctttttaacgtcggttaccgaggggtccggttacgggggacctaaacggggtccgaaaccgtccggtcggtcccgggtttcgggtttaccggggcgggaaacggggtacccgaaacggttccgttaccgggtaacccgttcccgtccgggttaccaccggttacccgaacgggccttcccccggg

SEQ ID NO: 333623 - DNA, 623 bp, Homo sapiens
  misc_feature: GZ8MTXP01B12HS.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgacgagataaatatgctgcctggatcagcaagaacgccaggccagtcccctggtcggtggtcatctatacaagacaccgaacgccggcccgtcggggactaccccgtggagcgtacttctacgtcggcctcccaccgttcgtacgggaaccacgacgacccactcctacgaccagtaccgacggaccggggacgcgacgggcgtaggtggtaagtcggaggggtcgttaggttaccttttacgtggtccgagggtcggtagggactaggccgaaccgcgtcggcccggtttgggttcccgggggacggaacggggtacccgaacggttccgttacgggtaaccccgtcccgtcgggtacccgaccgggaccccgaacgggttcccgttcccccgg

SEQ ID NO: 333624 - DNA, 586 bp, Homo sapiens
  misc_feature: GZ8MTXP01E1EJK.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (449)..(449): a, c, t, g, unknown or other
  misc_feature (449)..(449): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaacngccagcatcacctgctctgganataaattgacgagataaatatgctgcctggatcagcagaagccaggccacgtcccctggtggtggtcatctatcaagacaaccgaagccggcccgtcgggggactacccccgtgagcgattctctggcctccacctcgtacgggaacacgacgcccactcgtcgaccatcgaggacgggacgcgagggctggtaggatggaaggggtcttaggttaccttttacgngtcgagggcggttacgggactagccgacgacgtcggccggttcggtccggggcgggacgggacccgaaggttccgttaccggaaccccggtcccgtccgggtcgacccggaccccgtaacgggcccgttcccccggg

SEQ ID NO: 333625 - DNA, 636 bp, Homo sapiens
  misc_feature: GZ8MTXP01DKXHX.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (374)..(374): a, c, t, g, unknown or other
  misc_feature (374)..(374): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctgganataaattgacgagataaatatgctgcctggatcagcaagaagccaggccacgtcccctgtggtgtcatctatcaagacaccaagcggccctggggataccccgtgagcgtattctctggcctccacctcgtagggaaccacgagcccacttcncgacactcgaggccgggacgcgagggctgtggatggacggggtcttaggttacctttttacgtgtccgtagggtcggtacggggactacgggaccgtaccgaccgtcgggtccccgggttgggggtttccggggaccgggggtaaacgggggaccccgaaaaggggttcccgttacccgggtaaccccgggttcccggttaacccggggtaccgaacccggggttaccccgaaaccgggggttcccctttaaccccccgggg

SEQ ID NO: 333626 - DNA, 592 bp, Homo sapiens
  misc_feature: GZ8MTXP01C0NTH.51.60.F05.1.454.CMB.2.raw
  modified_base (428)..(428): a, c, t, g, unknown or other
  misc_feature (428)..(428): n is a, c, g, or t
  modified_base (464)..(464): a, c, t, g, unknown or other
  misc_feature (464)..(464): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgacgaagataaatatgctgcctggatcagcagagccaggccagtcccctggtggtgtcatctatcaagacaccaagccggcccgtcggggactaccccgtggacgcgtacttcgtctacgggccttcccaccgttccgtacggggaaccacacgcccactcgtcgaccactccgacggcgggaccgcgagggcctggnggtagtcggaacggggtcgtaggttaccttttacgnggttcgacgggtcggtacgggacgtaaggccgacgacgtcggccggttgggttccggggacgggaacggggaccgaaggccgttacggaaccgtccgtcggtcgacggacccgaacgggcctccccgg

SEQ ID NO: 333627 - DNA, 688 bp, Homo sapiens
  misc_feature: GZ8MTXP01D0UCO.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcttcctatgagctgattcagcccacctcagtgtccgtgtccccaggacaaacngccagcatcacctgctctgganataaatgacgaagaataaatatgctgcctggtatcagcaagaacgccacggcctacgtccccgtggtggtcggtcattctactacaacgaaccaccgaacggcccggtcccgtacgggggactaccccgtggacgtcgtactttccgtcgtcggccctcccgtaacccgtccggtaacgggaaccacgacgacccctacctacgtacgtaccacgtacgaaacgggaacggggaccgcggacgggcgttagggtggtagtagggtacgggggttacgtttacgggtttaacctttttacggttcggtacggtacggggtcggttaacggggaccgtaacgggccgaaaccgtccggtcgggtccggttcggggttaccggggcgggaacgggaccgaacggttccgttaccgggtaaccccgtccgtccgggtccgaccgggccgtaaccgggttcccgtccccgg

SEQ ID NO: 333628 - DNA, 564 bp, Homo sapiens
  misc_feature: GZ8MTXP01BOHGD.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (462)..(462): a, c, t, g, unknown or other
  misc_feature (462)..(462): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgcgagataaatatgctgcctggtatcagcaagaagccaggccacgtcccctgtggtggtcatctatcaagacaccaagccggcccgtcgggggactaccccgtggagcgtattctctcggcctcccacccgtctacgggaaccacgacgccactctcgaccatcgaggcgggacgcgaggctggtggatggaggggtcttaggtacttttacgtgtccgagggtcggtgggacnggcgacgcgtcggccggttggtcgggcggggacgggaccgaaggccgttacggaacccggtccgtcgggtccgacggaccccgaacggttccgtaaccccgg

SEQ ID NO: 333629 - DNA, 570 bp, Homo sapiens
  misc_feature: GZ8MTXP01CMEX5.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtcccccaggacaaacngccagcatcacctgctctgganataaattgacgagataaatatgctgcctggatcagcaagaagccaggccagtcccctgtggtgtcatctatcaagaccaccgaagccggcccgtcggggatacccccgtggagcgtattcctctcggcctcccacctcgtacgggaaccacacgcccacgtctacgaccatccagggcgggacgcgagggctggtggagtggaacggggtctttaggtaacctttttacgngttcgaggtcggtagggacngccgacncgtcgcccgggttggttccgggacgggacgggtaccaggccttacggaacccgtccgtccggtcgacgcccgaacgggttctccccggg

SEQ ID NO: 333630 - DNA, 573 bp, Homo sapiens
  misc_feature: GZ8MTXP01C693Y.51.60.F05.1.454.CMB.2.raw
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (435)..(435): a, c, t, g, unknown or other
  misc_feature (435)..(435): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgcgagataaatatgctgcctggatcagcagaagccaggccagtcccctggtggtggtcatctatcaagacaccaagccggcccgtcggggactaccctggagcgtattctctggcctccaccctcgtacgggaacacgacgcccactctgaccatcgagcggggacncgaggctgnggatggagggggtcttaggtacttttagngttacgagggtccgtaggggactaggccgacgtcgtcggcccgggttggttacccgggcggggaacgggacccaaggcccgttacgggaaccccggttccgtcgggtccgaaccggcccgaaggggcccttccccggg

SEQ ID NO: 333631 - DNA, 667 bp, Homo sapiens
  misc_feature: GZ8MTXP01D5XOT.51.60.F05.1.454.CMB.2.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctcngganataaatgacgagataaatatgctgcctggatcagcaagaacgccaggccacgtccccgtggtggtggtcatctatcaagacacagccggccgtcggggactacccgtggacgcgtacttctcgtcggcctccaccgtcgtacgggaacacgacgcccactctcgacacgtcgacgggacgggacgcgacggcgtgggtaggacgtacggacgggggttcgtttaggtttaacctttttacggtacggttaccggaacggggtccgggttacggggaaccgtacgggacccgtaaaccggttccggttccggtcccggggttggggttacccgggggacggggaaccgggtaacccgaaacgggttccgttacccgggtaaccccggttcccggtaacccgggtccggaacccggaccccggtaacgggttccccgttcccccggg

SEQ ID NO: 333632 - DNA, 580 bp, Homo sapiens
  misc_feature: GZ8MTXP01D57FS.51.60.F05.1.454.CMB.2.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
  modified_base (434)..(434): a, c, t, g, unknown or other
  misc_feature (434)..(434): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctganataatgcgagataaatatgctgcctggtatcagcaagaagccaggccagtcccctgtcggtgtcatctatcaacgacaccaagccggccgtcggggactaccccgtggagcgattcacgtgctccacgtcgtagggacacagccactctacgacatcgacggacgggacgccgagggctggtggagtggaggggtcttaggtaccttttacgnggttccgaggtcggtagggaccgtaggcgacgtacgtcgtcccggttggttccggggacgggtaccggggaaccaacgggttccgttacggaaccccggttccgtaaccgggtccgacgaccccgtaacgggttcccttccccggg

SEQ ID NO: 333633 - DNA, 549 bp, Homo sapiens
  misc_feature: GZ8MTXP01D86MC.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (448)..(448): a, c, t, g, unknown or other
  misc_feature (448)..(448): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaattgcgaagataaatatgctgcctggatcagcaagaagccaggccacgtcccctgtggtggtcatctatcaagacacaagcgccgtcgggatcccctgacgcgattcctctcgggcctccctacctccgtacggggaaaccacgacgacccacgtctacggaccatcgacggcgggacgcgaggctaggtggaatggacgggggtcttagttactttacgngtccgaggcggtagggcagcgacgcgtcgtccggttggttcgggcggaacgggccaaggcgttacgaacccgtcgtcggcacgcccgaacggcgtccccgg

SEQ ID NO: 333634 - DNA, 731 bp, Homo sapiens
  misc_feature: GZ8MTXP01EOF8H.51.60.F05.1.454.CMB.2.raw
  modified_base (206)..(206): a, c, t, g, unknown or other
  misc_feature (206)..(206): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcgagtcgtccgtcgtacccgagaacaaacncgaccagcactccacctgcctgtaggagtaattaaagtgagaagtaaataaatagtcgctcgaccgtaggtacacgagacgaagaacgaccgacggccaccgtcccgtggtggtacgtactacgtactataacgaaacgaccaaccgaacggccccggtaccggtacggggtaactaccccgtaggacggtcgttaccttcgtccgtcggtccctacccgtaaccgtcggtaacgggaaccaacgacgtacccctacttacgacaaccgtacgacggacgggggaacccgggcgtacgtaccgggggtggtaggtaggtaggtaggtacggggttacggtttacgtttaacgtttacgttacggtacggtacgggtacgggtacgggacgtacggaccgtaccgtaccggtccgggttcgggttcggggtacggggaccgggaacgggaaccggacggttccggttaccggtaacccggtcccggtccggaccgaccggaccggtaaccggttcccggtccccgg

SEQ ID NO: 333635 - DNA, 631 bp, Homo sapiens
  misc_feature: GZ8MTXP01AO83K.51.60.F05.1.454.CMB.2.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (399)..(399): a, c, t, g, unknown or other
  misc_feature (399)..(399): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccacctcagtcgtccgtcgtccccaggacaaacngccagcatcacctgctcgtagganataaatgacgaagaataaatatagctgcctggtatcagcagaagccaggccagtcccccgtggtcggtggtcatctatacaaacgaccaaccgaacggccggtcccgtcgggggactaccccgtgagtcgtacttctcgtcggcctcccaccgttcgtacgggaacacgacncccgactctgaccagtcaggtcgggacgacgaggcgtgtggagtggacggggcgtttacggtacgttttaacgtgttcgagggtcggtacggggactaggccgtaccgacgtcgggtccggttggggttccgggacggggaccgggttaaccgacggttccgttccgggtaaccccgttcccggccgggttaccgaccggacccggtaaaccgggttccgttcccccccggg

SEQ ID NO: 333636 - DNA, 602 bp, Homo sapiens
  misc_feature: GZ8MTXP01DKTX6.51.60.F05.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
  modified_base (342)..(342): a, c, t, g, unknown or other
  misc_feature (342)..(342): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgcgaagataaatatgctgcctggatcagcagaagccaggccagtccccngtggtgcatctatacaagacaaccgaagccggccgtcggggactaccccgtggagcgatttcnctcggcctcccaccgtcgtacgggaaacacgagcccactcctacggaccagtccgaggaccggggacgcgaggcgtaggtggagttggacgggggtcgttacgttaactttttaccgtgttcgagggtcggtagggacgaggaccgacgacgttcggtccggttgggttccgggaccggggaacgggacccgaacggttcttaccgggaacccgttccgtccggtccacggttaccccgaacggggcccttaaccccggg

SEQ ID NO: 333637 - DNA, 557 bp, Homo sapiens
  misc_feature: GZ8MTXP01DSM45.51.60.F05.1.454.CMB.2.raw
  modified_base (222)..(222): a, c, t, g, unknown or other
  misc_feature (222)..(222): n is a, c, g, or t
  modified_base (342)..(342): a, c, t, g, unknown or other
  misc_feature (342)..(342): n is a, c, g, or t
  modified_base (437)..(437): a, c, t, g, unknown or other
  misc_feature (437)..(437): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaatgcgagataaatatgctgcctggatcagcagaagccaggccagtcccctggtggtggtcagtctatcaagacaccaagccggccctcggggataccccgtggagcgtattcctcnggcctccaccctcgtcgggaaccacgagcccactctacgaccatcgagcgggacgcgaggctagtggagtggaggggcttacggtacttttacgngttcgacgggcggttaggggactaggcgacgacgtcggccggttggttcgggcgggaacggggaccaaggccgttacgtaacccggtccgtcgggtcacggccccaagggccctccccgg

SEQ ID NO: 333638 - DNA, 705 bp, Homo sapiens
  misc_feature: GZ8MTXP01EUAXL.51.60.F05.1.454.CMB.2.raw
  modified_base (343)..(343): a, c, t, g, unknown or other
  misc_feature (343)..(343): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgacgagataaatatgctgcctggatcgagcaagaacgccaggcctacgtccccgtggtcggtggtctatactatacaacgaccaccaaggccggcccgtacggggactaccccgnggagcgtattcgtactcggcctcccacctcgtacgggaacctacgacgccctacgtcctacgaccctagtaccgacgggacgggaccggacgaacggggtccttgggtacgggtaacgttggggaacgggggttccgtttacggggtttaaacctttttacggtacgggttaccggaacggggttccgggttagggggaaccgtagggaccggtaaccgtaaccggtcgggtacccgggttcggggttccggggaccggggtaaacggggaaccgttaacgggttccggttacccggtaaccccggttccggtccgggttccgaccggttaccccggaacgggttccccgttaacccccggg

SEQ ID NO: 333639 - DNA, 678 bp, Homo sapiens
  misc_feature: GZ8MTXP01A0S0C.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctgganataaattgacgagataaatatgctgcctggatcagcagaacgccaggccacgtcccctgtggtggtcatctatacaagaccaccgaagccggcctcggggactaccccgtgagcgattctcgtggcctccacctcgtacgggaacacacgcccactctacgaccactcgagggccgggaacgcgacggctgggtaggagttgggaacggggtcgttacggtttaccgttttacgtggtcccggtaaggggtcccggttaagggggacctaacgggacccgtaaccgttaacccgggtcgggtaccccggggttcgggggtttaccgggggaccgggggtaaaccggggaaccccgttaaacgggttcccgttaccgggtaaccccgggttcccggtcccggggttacccgacccggggttaccccggaaccggggttccccgtttaaccccccgggg

SEQ ID NO: 333640 - DNA, 698 bp, Homo sapiens
  misc_feature: GZ8MTXP01CCLIP.51.60.F05.1.454.CMB.2.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggattttgtggcctcctatgagctgattcagccacctcagtgtccgtgtccccaggacaaacngccagcatcactgctctgganataaattgacgaagataaatatgctgcctggatcagcagaagccaggccagtcccctggtggtggtcagtctatcaacgacaccgaacgccggcccgtcggggactaccccgtggacgcgtacttcgtcgtcggcctccgtacctcgtacgggaaccacacgccctactctacgacctacgacgacgggacggggaacgcgagggtccgtggtgggaagtcgggacgggggtcgtttacggtttaccgtttttacgtcggttaccggaacgggggtccggttaacgggggactacgggacccggtaaaccgtccggtaacgggtcccggggtttcgggttaccgggggaccgggggtaacggggaacccgttaaacgggttcccggttaaccggggtaacccccggttcccgggttcccgggttacccggaacccggttaccccggaaaccggggttccccgtttaaccccccgggg

SEQ ID NO: 333641 - DNA, 633 bp, Homo sapiens
  misc_feature: GZ8MTXP01D5LC2.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (334)..(334): a, c, t, g, unknown or other
  misc_feature (334)..(334): n is a, c, g, or t
  modified_base (412)..(412): a, c, t, g, unknown or other
  misc_feature (412)..(412): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtgtccgtgtccccaggacaaacngccagcatcacctgctctgganataaattgacgaagataaatatgctgcctggtatcagcaagaagccaggccagtcccctgtggtggtcatctatcaacgacaccgagccggcctacgggggacttaccccgnggagcgtattcctctcgggcctcccgacctacgtacgggaaccacgacgccctactctcgaccatcgaggccgggacncgacgggctgtggagtggacggggtacttgttaccttttacgtggtccgaggggtcggtacggggacgtacggccgtaaccgcggtcgggtccccggtttggggttcccggggacggggaaccggggaacccgttaacgggccgttaccggggaaccccgggttcccgtccggggttcccgacccgggaccccgtaaacgggttccccgttccccccgggg

SEQ ID NO: 333642 - DNA, 551 bp, Homo sapiens
  misc_feature: GZ8MTXP01C62DK.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgcgaagataaatatgctgcctggatcagcagagccaggccagtcccctggtggtggcatcatcaagacaccagccggcccgtggggactaccccgtgaacgtcgaattcgtcttcgggccttcccaacccgtcgtacggggaaccacgacgccctactctacggacctanccgaggcgggaccgcgacgggctgngaatggaggggctgtacttttacggngtcgnggcggtaggacgtgcgacgtcgtcggtcggttggtcgggacggacggacgacgcgttacggccgtcgtcggtcgtacgttaccgtaacggccgtccg

SEQ ID NO: 333643 - DNA, 598 bp, Homo sapiens
  misc_feature: GZ8MTXP01BEX5Y.51.60.F05.1.454.CMB.2.raw
  modified_base (199)..(199): a, c, t, g, unknown or other
  misc_feature (199)..(199): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctggagataaattgcgagataaatatgctgcctggatcagcaagaagccaggccagtcccctggtggtgtcatctatacaagacaccaagccggaccgtggggactaccccgtggagcgtattctctcggctcccacctcgtacgggaacacgacgcccacttcacgaccatcgaggcgggacncgaggctgngatggagggtctaggtactttacgngtccgagggtcgtacgggactaggccgacgacgtcggccccggttgggttccgggacggggaaacgggtcccgaaagggttcccgttaccgggtaacccccggttcccggttaacgggtaccccggaccggacccccggtaacgggttccccgttccccccgggg

SEQ ID NO: 333644 - DNA, 679 bp, Homo sapiens
  misc_feature: GZ8MTXP01BLFZA.51.60.F05.1.454.CMB.2.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctctatgagctgattcagccacctcagtcgtccgtgtccccaggacaaacngccagcatcacctgctctggatataatgacaagataaantgctgcctggtancagcaagacgccgtaaggcctagtccccgtggtcggtcggtaccatacctaatacgaacgaccgaacgacggccggtaccggtacgggactacccgaggacgtcgtacttcgtacgtcgtcctaccgtaccgtacggacggaaccacgacgtacctacgtcgtacgaaccacgtaccggacgggtaccgggacgtcggacggtacggtaggtaggtagtacggtacggggttacgttacgtttacgtttacgttacggtacggtacgggtacgggtacggtacggtacggtaccgtaccgtacggtcgggtccgggttcgggtacgggaccgggtaaccgggtaaccggttacggttccggttaccggtaacccggtacccggtccggtaccggtaccggttacccggtaaccggttcccggtcccg

SEQ ID NO: 333645 - DNA, 592 bp, Homo sapiens
  misc_feature: GZ8MTXP01DQ2NF.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (473)..(473): a, c, t, g, unknown or other
  misc_feature (473)..(473): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaattgacgaagaataaatatgctgcctaggatcgagacaaggaacgccgaggccacggtccccgtggtggtgtcatctatacaaagaccaaccgacggccggcccgtacggggactaccccgtggacgcgtattccgtcgtcggtcctcccaccgtcgtacgggaaccacgcgacccactctacgaccatcgacggcgggacgcgaggcgtggtaggagtggacggggtcttaggttacctttacgnggtcgacggtcggtacggactggcgacgacgtcggtcggttcgggtcgggacgggacgggacacggttccgttcggtaacccgtccgtcggtccgacgacccgtaacgttcgtccccgg

SEQ ID NO: 333646 - DNA, 622 bp, Homo sapiens
  misc_feature: GZ8MTXP01AKIDX.51.60.F05.1.454.CMB.2.raw
  modified_base (477)..(477): a, c, t, g, unknown or other
  misc_feature (477)..(477): n is a, c, g, or t
  modified_base (506)..(506): a, c, t, g, unknown or other
  misc_feature (506)..(506): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcacgcccaccctcagtcgtcccgtcgtcccccaaggaaccaaacacgccagcatccacctgctcgtaggaagtaattaaagttgacgaagtaattaaatatgctgcctggatcagcagaacgccaggccctacgtcccccgtggtggtggtacatcgtatacgaaacgaccaaccgaaacggcccggtcccgtacgggggaactaccccgtggacgtcgtacttcgtacctcgggcctcccacccgtcgtacgggaaccacgacgccctactcctacggaccagtcacgggcggacgcgaggcgttggaggntaggcggggtcgttgttaccgttttacgnggtcggagggccggtagggacctggacgaccgcgtcggccggttgggtccgggacgggaggaccagttccgttcgtaacccgtcgtccgcgccgacccgtaacggcctcccccggg

SEQ ID NO: 333647 - DNA, 634 bp, Homo sapiens
  misc_feature: GZ8MTXP01AZ74G.51.60.F05.1.454.CMB.2.raw
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (479)..(479): a, c, t, g, unknown or other
  misc_feature (479)..(479): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcagtcgtccgtcgtccccaggacaaacngccagcatcacctgctctgganataatgacgagataaatntgctgctggtatcagcagagccaggccagtcccctggtggtgtcatctatcaagacaccgagccggccgtcggggactaccccgtgacgtcgtattcctaccgtggccctaccaccgtcgacggggtaaccacgacgcccacttcctacggaccctagtaccgacgggacccggggacgcgacgggccgttgggacggagttggacgggggttccttaggttacctttttacggngttcggacgggtcgggttacgggcctaacggccgtacaccggttcggccggtttcgggtaccggggccgggaaccgggacgaacggttccgttaccggtaacccggttcccgtccgggtaccaccggttacccgtaacgggcccgttcccccggg

SEQ ID NO: 333648 - DNA, 604 bp, Homo sapiens
  misc_feature: GZ8MTXP01CHYME.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctgganataatgngagataaatngctgctgatcagcagacgcaggccacgtcccctggtcggtgtcagtctatcaaacgacaccgaacggccgacccgtcggggactaccccgtggacgcggtattccgtacgtacgggtcctacctacccgtcggtagggaaccacgacgaccctactcgtacgaccacgtcgaggaccgggacgcgtaggcgtgtggaactgggacgggggtcttggttaacctttacgngtacgngggtcggtacgggacgcgtacgactacgtcggtccgggttgggttccggggacggaacggggaccaacgggttccacggtcccggtacccgtccggtacgaccggacccgtaacgggttcccgtccccggg

SEQ ID NO: 333649 - DNA, 582 bp, Homo sapiens
  misc_feature: GZ8MTXP01BK4M8.51.60.F05.1.454.CMB.2.raw
  modified_base (426)..(426): a, c, t, g, unknown or other
  misc_feature (426)..(426): n is a, c, g, or t
  modified_base (456)..(456): a, c, t, g, unknown or other
  misc_feature (456)..(456): n is a, c, g, or t
  modified_base (486)..(486): a, c, t, g, unknown or other
  misc_feature (486)..(486): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaacagccagcatcacctgctctggagataattgacgagataaatatgctgcctggtatcagcagagccaggccagtcccctggtcggtggtcatctatacaacgaccaccgaaggccggcccgtcggggactacccccgtgacgcgtattctctcggcctcccacctcgtacgggaaccacgacgaccctactcgtacgaccagtccgacggccgggacgcgacggctggnggagtggaggggcgttagtactttttacgngttcgaggcggtagggactacggccgaacncgtcggtcccggttgggttccggacgggacggaccgaacggccgttacggaaccccgtcgtccggtcgacggaccccgaacggttcccgtccccgg

SEQ ID NO: 333650 - DNA, 608 bp, Homo sapiens
  misc_feature: GZ8MTXP01AZMTV.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaattgacgagataaatatgctgcctggatcagcagaacgccaggccacgtcccctggtggtggtcatctatacaagacaccgaagccggccgtcggggactaccccgtgacgtcgtacttctcgtcggcctacccgacccgtcgtacggggaacacgacgcccactcgtacgaccacgtcgaggaccgggacgcgagggctggtggagtggaggggtcttggttaccttttacgtaggtcgacggggtcggtaggggacgtaggccgactcggtcggtccggttgggttaccgggcgggaacggggaaccgaacggttccgttacgggtaaccccggtccgtcgggtccgaccggaccccggtaacggttccccgtccccggg

SEQ ID NO: 333651 - DNA, 624 bp, Homo sapiens
  misc_feature: GZ8MTXP01BUWLB.51.60.F05.1.454.CMB.2.raw
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (460)..(460): a, c, t, g, unknown or other
  misc_feature (460)..(460): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagttgtccgtcgtccccaggaccaaacngccagcatcacctgctctgganataatgacgagaataaatatgctgctgatcagcagagccaggccacgtcccctggtcggtgtcatctatcaagacaccgaggccggcccgtcggggactacccgtggacgcgtattccgtactcggcctcccaccgtcgtacgggacacacgcccactcgtacgaccatccgagggccgggacgtcgagggcgtgtagggattgggacgggtactttcggttaccttttacggnggttacgacggggtcgggtagggacctacgggaccgacgtccggtcggtcccggttcgggggttcgggaccggggaacggggtaccgaacggttccgttacgggtaaccccggttcccgtcgggtcccgacggttacccgaacgggttcccgttaacccccggg

SEQ ID NO: 333652 - DNA, 626 bp, Homo sapiens
  misc_feature: GZ8MTXP01AXW0U.51.60.F05.1.454.CMB.2.raw
  modified_base (201)..(201): a, c, t, g, unknown or other
  misc_feature (201)..(201): n is a, c, g, or t
  modified_base (342)..(342): a, c, t, g, unknown or other
  misc_feature (342)..(342): n is a, c, g, or t
  modified_base (421)..(421): a, c, t, g, unknown or other
  misc_feature (421)..(421): n is a, c, g, or t
  modified_base (462)..(462): a, c, t, g, unknown or other
  misc_feature (462)..(462): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctcgtaggagataaattgacgaagataaatatgctgcctggtatcagcagaagccaggccagtccccgtggtggtggtcatctatacaagaccaccgaacggccggccgtacgggggatacccccgnggagcgtacttcgtcgtacggcctccctaccgtcgtacgggaaccacgacgccactctacgaccatcgacggcgggacncgacggctggtggattggacggggtcttagttacctttcgnggtcgacggtcggtagggacacgggtaccgacgacggtcgggtccggttcggggttccggggaccggggtaacgggaacccgttaacgggttccggttaccggtaaccccggtaccgtccgggtaccgacccggttacccggtaacgggttccccttccccggg

SEQ ID NO: 333653 - DNA, 567 bp, Homo sapiens
  misc_feature: GZ8MTXP01A2V7R.51.60.F05.1.454.CMB.2.raw
  modified_base (200)..(200): a, c, t, g, unknown or other
  misc_feature (200)..(200): n is a, c, g, or t
  modified_base (412)..(412): a, c, t, g, unknown or other
  misc_feature (412)..(412): n is a, c, g, or t
  modified_base (468)..(468): a, c, t, g, unknown or other
  misc_feature (468)..(468): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggtatcagcagaagccaggccagtccccctggtggtggtcatctatcaaagaccaccaagccggcccgtcggggactacccctgagcgtattctctggcctcccacctcgtcgggaacacacgcccactctacgaccagtccagggccgggacgccgaggctgnggatggaggggctaggtacctttagtgtcgagggccggtagggacaaggccgaacncgtgggccccgttgggttccgggcgggaagggaacccaggccttacgggtaacccgttccgtccgggtccgaacggccccgaagggttcctcccccggg

SEQ ID NO: 333654 - DNA, 709 bp, Homo sapiens
  misc_feature: GZ8MTXP01DIPH8.51.60.F05.1.454.CMB.2.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctctatgagctgattcagccaccctcagtcgtccgtcgtccccaggacaaacngccagcatcactgctntganataatganagataatntgctgctgancagcagaacgcacggccacgtcccctggtggtgtcagtctaatacaaagaaccaccgaaaggtccggcccgttacgggggaacttacccccgtggacgtccgtactttccgtacgtcgccctccctaacccgttcggtaacggggaaaccacgacgtaccctacctacgtacgaaccgactaccggaacgggacccggggaaccgccggaacggggtccgttgggtaacggtacggttagggtacgggggtacgtttacggtttaaccgtttttaacggtcggttaccggtacggggccgggttacggggaccgtacggtaccggaccgtaacggtccgggtccggttcggggttaccggggacggggtaaccgggtaaccgaacggttccggttccgggtaaccccggtcccgttccggtaccggaccgaccccggtaaacggttccccgttaacccccgg

SEQ ID NO: 333655 - DNA, 677 bp, Homo sapiens
  misc_feature: GZ8MTXP01E0XW0.51.60.F05.1.454.CMB.2.raw
  modified_base (177)..(177): a, c, t, g, unknown or other
  misc_feature (177)..(177): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (394)..(394): a, c, t, g, unknown or other
  misc_feature (394)..(394): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctnagtgtccgtgtccccagacaaacagccagcatcacctgctctggaagataaattgacgtaagtattaaatatgctgcctggatcagcaagacgccaggccagtccccgtgtggtgtcatactanaccaacgacaccgacgccggcccgtcggggactccccgngagcgtattctctcggcctcccgacctcgtacgggaaccacgacacccactccncgaccacgccgacgggccggaacgcgacgggtcgtggtggagtcggtacggggtacttacggttaccgtttaccgtcgggttccgtcgggggtaccgtacggggaccgtaacggacccggttaaccggcccgggttcgggtcccgggttcggggttaccgggggaacccgggtaaacggggtcccaaaaacgggggcccccttggggtaaccccgggtacccgtcccccgggtttaccccggacgggttcccctaaaaccccggggcccccgtttaaccgggg

SEQ ID NO: 333656 - DNA, 578 bp, Homo sapiens
  misc_feature: GZ8MTXP01CYMP2.51.60.F05.1.454.CMB.2.raw
  modified_base (175)..(175): a, c, t, g, unknown or other
  misc_feature (175)..(175): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctnagtgtccgtgtccccaggacaaacagccagcatcacctgctctggagataaattgcgaagaataaatatgctgcctggtatacagcaagaacgccaggccagtcccctggtggtgtcatctatcaaagacaaccgaagccggcccgtagggggactacccccgtggacgcgtacttcctactcggcctccctacctacgtacgggaacacacgccctactctacggacagtacgaggacgggtacgcgagggcctagggtgaagtgggaacgggccttaggttaccgttttactggtaccgaggtcggtacgggactagcgacgtagtcgcggttagggtcggcgggtacggacgacgcttacggccgtaccgtcgtccgacgaccgtaacggcctccccggg

SEQ ID NO: 333657 - DNA, 582 bp, Homo sapiens
  misc_feature: GZ8MTXP01D8QW2.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (441)..(441): a, c, t, g, unknown or other
  misc_feature (441)..(441): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctgganataatgcgagataaatatgctgcctggtatcagcaagaacgccaggccagtcccctgtgtggtcatctatcaagacaccaagccgcctcggggactaccccgtgacgcgtattcctctggcctccacccttcgtacgggaacacagcccactctacgaccagtcaggacgggacgcgaggctgtggagtgacggggtcttagttacttttacgtgttcgngggtcggtacgggacgtaggacgaccgtacggtcggtccggttgggttccgggcgggaacgggtaaccgaacgggttccttacggtaacccggtcccgtcgggtaccaccgggacccgtaacgggttccgttaaccccggg

SEQ ID NO: 333658 - DNA, 653 bp, Homo sapiens
  misc_feature: GZ8MTXP01CU8R7.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtcgtccccaggaacaaacagccagcatcacctgctcgtaggagaataaattgacgaagaataaatatgctgcctggatcagcagaacgccaggccagtcccctgtggtggtcatctatcaaagaccaccgaaggccggcccgtcgggggactaccccgtggacgcgtacttcctcgttcgggccctcccacccgttcgtacggggaaccacacgaccctacctctacgacctagtaccgacgggaccggggacgcgaagggtcgttagggtggagttagggaggggtcgttacggtttacgttttacgtggtacgagggtccggtaggggacctaggccgtacgtacggtcgggtcccggttcggggttccggggacggggaaacggggcccttaaacgggccgttcccgggaacccggttcccgtccgggtccgaccggaccccgtaacgggttcccgttcccccggg

SEQ ID NO: 333659 - DNA, 788 bp, Homo sapiens
  misc_feature: GZ8MTXP01ETDE3.51.60.F05.1.454.CMB.2.raw
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccacctcagtcgtccgtcgtccccaggaccaaacngccagcatcacctgctctgganataaatgacgaagaataaatatgctgcctggtatcagcaagaacgccgaggccacgtccccgtggtcggtggtcagttctataccaaacgaccgaaccgaaacggcccggacccgtacgggggacttaccccccgtggaacgtccgtaatttccgtaccgtcgggcccttacccgtaaccctccggttacggggaaaccaccggacgtacccctaacgtcctacggaacccacgtaccgaacggggacccggggaaccgcggaacggggtccgttcgggtaaggggtaagtcggggacggggttcgtttaacggggtttaacctttttaaacggtccggttaccggacggggtaccgggttacgggggaaccgtacgggacccggtaaacccttccgggtcggggttaccccggtttgggggttacccggggaccgggggtaaaccgggacccgttaaacgggttccccggttaaccggtccccccggggttaacccgttccgggggtaccccgtaaccgggacccccggtaaccggggttccccgtttaacccccccgggg

SEQ ID NO: 333660 - DNA, 582 bp, Homo sapiens
  misc_feature: GZ8MTXP01C7I97.51.60.F05.1.454.CMB.2.raw
  modified_base (200)..(200): a, c, t, g, unknown or other
  misc_feature (200)..(200): n is a, c, g, or t
  modified_base (497)..(497): a, c, t, g, unknown or other
  misc_feature (497)..(497): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggatcagcagaagccaggccagtcccctggtggtggtcatctatacaagaacaccgaaaggccggccccgtcgggggactaccccgtggacgcgtacttctccgtgggtcctccctacccgtcgtacggggaaccacgacgcccactctacgacccatccgaaggccgggacgcgacgggctggtggagtggaggggtcgttggttactttttacgtcggttccgagggccgtagggacaggcgaacncgtggccggttggtccgggaggggacggaccgaaggccttcggaacccgtccgtcgggtccacggaccctaacgggcctccccgg

SEQ ID NO: 333661 - DNA, 590 bp, Homo sapiens
  misc_feature: GZ8MTXP01C6QLS.51.60.F05.1.454.CMB.2.raw
  modified_base (458)..(458): a, c, t, g, unknown or other
  misc_feature (458)..(458): n is a, c, g, or t
  modified_base (488)..(488): a, c, t, g, unknown or other
  misc_feature (488)..(488): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtcgtccccaggacaaacagccagcatcacctgctctggagataaattgcgagataaatatgctgcctggtatcagcagaacgccaggccacgtcccctgtggtgtcatctatcaagacaccaagccggcccgtcggggactaccccgtggacgcgtatcgtctggcctccacccgtcgtacgggaaccactacgacccactctacgaccagtccgacggccgggacgcgagggcgtggtcggagtcggacggggtctaggttaaccttttacgngttccgagggtcggtagggacaggccgacncgtaacggccggttaggtccgggacgggtaacgggaccgaaggccgttacggccccggttacccgcgggtacccgacggacccctaagggcccgttccccgg

SEQ ID NO: 333662 - DNA, 515 bp, Homo sapiens
  misc_feature: GZ8MTXP01EKBKC.51.60.F05.1.454.CMB.2.raw
  modified_base (199)..(199): a, c, t, g, unknown or other
  misc_feature (199)..(199): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
  modified_base (451)..(451): a, c, t, g, unknown or other
  misc_feature (451)..(451): n is a, c, g, or t
  modified_base (499)..(499): a, c, t, g, unknown or other
  misc_feature (499)..(499): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctggagataaatgacgagataaatatgctgcctggtatcagcagaagccaggccagtcccctggtggtggtcatcatcaagacaccagccggccctcgggggataccccgtgagtcgattctctcggcctccacctctacggggaaccacacgcccactctcgaccatcgaggcgggacgcaggcngtgagtgaggggtctggtaccttttagngtcgaggcgtaggacagcgacncgtggccgttggtcggcggagggaccaggcttcggaaccgtctcggcncgccgaacgcgtcccg

SEQ ID NO: 333663 - DNA, 498 bp, Homo sapiens
  misc_feature: GZ8MTXP01A4I7O.51.60.F05.1.454.CMB.2.raw
  modified_base (200)..(200): a, c, t, g, unknown or other
  misc_feature (200)..(200): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggtatcagcagaagccaggccagtcccctgtggtggtcatctatcaagacaccaagcgcctcgggggatacccctgagcgattctctgggctccacctctgggaacacagccactctgaccatcagcggancagctgtggatgagggctggtactttacgngtcgaggcgtacgggcaggcgacacgtgccgttggtccggcggagggccaagcttgaacccgtctcggtcacgcccgaaggcctcccgg

SEQ ID NO: 333664 - DNA, 601 bp, Homo sapiens
  misc_feature: GZ8MTXP01DG97T.51.60.F05.1.454.CMB.2.raw
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (489)..(489): a, c, t, g, unknown or other
  misc_feature (489)..(489): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctgganataaattgcgagataaatatgctgctggancagcagacgccaggccacgtcccctggtggtggtcatctatacaacgacaccgagccggcccgtcggggactacccgtggacgcgtacttcctcgtcggtcctcccaccgtcgtacgggaaccacgacgccctactcctacgaccagtcgagggaccgggacgcgagggtctgggtggaagtggaggggtcttcggttaacttttaccgtggttccgaggggtcggtacggggacncggacgaccgcgtcggtcccggttgggttcgggacgggtacgggtaccgaggttccgttacgtaacccggtcgtccgggtcacgggttacccgaacggttcccgtcccccgg

SEQ ID NO: 333665 - DNA, 557 bp, Homo sapiens
  misc_feature: GZ8MTXP01CKGNM.51.60.F05.1.454.CMB.2.raw
  modified_base (267)..(267): a, c, t, g, unknown or other
  misc_feature (267)..(267): n is a, c, g, or t
  modified_base (362)..(362): a, c, t, g, unknown or other
  misc_feature (362)..(362): n is a, c, g, or t
  modified_base (430)..(430): a, c, t, g, unknown or other
  misc_feature (430)..(430): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagccaccctcagtcgtccgtcgtaccccaaggaaccaaacagccagcatcacctgctcgtaggagaataaatgacgaagaataaatatgctgcctggactnagcaagaacgccaaggcacgtcccctggtggtgtcatctatacaagaccaaccgaagccggacccgtaggggactaccccgtgacgtcgtattcncgttcgcctacccactcgaggaacacgacgccaactcagacccagccgaggcggacgcgacggctggngagtggagggtcttagtactttacggngtcgnggcggaggacgcgacgacgcgtcgtcggttggtcgggacggacgacacgcgttaccgtaacccgtccgtcgccgaccgaccgtaacgccgtcccg

SEQ ID NO: 333666 - DNA, 683 bp, Homo sapiens
  misc_feature: GZ8MTXP01C4UQR.51.60.F05.1.454.CMB.2.raw
  modified_base (227)..(227): a, c, t, g, unknown or other
  misc_feature (227)..(227): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcagtcgtccgtcgtccccaggaacaaacagccagcatcacctgctctgganaataaattgacgaagaataaatatgctgcctggtatcgagcaagacgccaggccacgtccccgtggtggtgtacatctatacaaacgaccaaccgaacggcccggcccgtacggggactaccccgtggacgtcgtacttctcgtcggtccctaccctaccgtacgtacgggaaccacgacgccctacgtcctacgaaccactaccggacgggaccggggacgcgtacgggtcgtagggtaggacgtgggaacggggtcgtttacggtttaaccttttacgcggttaccggacggggtcggtaacggggacgtacgggaccgtaaccgtacggttcgggtccgggttcggggttaccggggacggggtaaaccgggtaacccgaacgggttccgttaccgggtaacccgttcccgtccgggtccgacccggacccgtaacgggttcccgttccccgg

SEQ ID NO: 333667 - DNA, 636 bp, Homo sapiens
  misc_feature: GZ8MTXP01ER4LY.51.60.F05.1.454.CMB.2.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagcccacctcagtcgtccgtcgtcccaggacaaacngccagcatcacctgctctagganataaagtgacgagaataaatatgctgcctggactcagcaagaacgccacggccagtccccgtggtggtgtcatctatacaacgacaaccgaaggccggcccgtacggggactaccccgtaggacgtcgtacgttcctcgtcggtccctcccgacctcgtacgggaaccacgacgcccactctacgaccagtccgaacgggccgggacgcgacgggctaggtggagtcggacggggtcgttaggttaccgttttacgtcgtcggtacgggtcggtacgggacgacgtccggaccgacggttcgggcccggttagggtaccgggaccgggtaacgggaaccgacgggttccgttacggtaaccccgggttcgtccggtccgaccggttaccccggtaacggttcccgtccccggg

SEQ ID NO: 333668 - DNA, 604 bp, Homo sapiens
  misc_feature: GZ8MTXP01AJZ9M.51.60.F05.1.454.CMB.2.raw
  modified_base (174)..(174): a, c, t, g, unknown or other
  misc_feature (174)..(174): n is a, c, g, or t
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctctatgagctgattcagccaccctnagtgtccgtgtccccaggacaaacngccagcatcactgctctgganataatgaganataatatgctgcctggatcagcagaagccaggccagtcccctggtcggtggtcatctatcaaacgacaccaagccggcccgtcggggactaccccctggacgcgtactttcgtcctcgggcctcccaacccgtctacggggaaccacgacgcccaactctacgaccagtacgagccgggacgtcgagggccgtaggttcggattcgggacgggggtcttggttaccttttacgtcgttccgagggtcgtacgggggaccgtcggaccgtaccgtcggtcgtccgggttcgggtacgggaccgggtacgggtaaccgacgttccgttaccggtcccgttccgtccggaccgaccgaccccgtcgttcccgtcccg

SEQ ID NO: 333669 - DNA, 775 bp, Homo sapiens
  misc_feature: GZ8MTXP01DIYYP.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctgagtcgtccgtcgtaccccgaggaacaaacgacgccagcatccgacctgctcgtaggagtaaattaaagttgacgtaagtaaattaaaatgtcgtcgttcgtaccgttaggtacaccgaaggacgaaagaaccggacccgaccggtacccgtaacccggttccccgtgggttcgggtacggtacctaacgttactaacgtaacgaacgaaaccaaaccggacggccccgggtaacccggttacggggaacctttaaccccggaggacgtaccgttacttcccgtcgtaccggccttacccctaccgttacgggaacggaaacccacggacgtccccaacttcctaacggaacctagaccgacggggacccggggttaacgcggacgggtggtacggtaggtacgtacggtacggggtacgtttacgtttacgtttacggttacggtacggtacgggtacggtacggacggtacgaccgtaccgtcggtcggtcgggttcgggtacgggacgggaacgggtaacggttacggttccggttaccggtaacccggtcccggtaaccggtaccggaccggacccggtaaccggttcccgtcccg

SEQ ID NO: 333670 - DNA, 552 bp, Homo sapiens
  misc_feature: GZ8MTXP01ACWDM.51.60.F05.1.454.CMB.2.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (368)..(368): a, c, t, g, unknown or other
  misc_feature (368)..(368): n is a, c, g, or t
  modified_base (447)..(447): a, c, t, g, unknown or other
  misc_feature (447)..(447): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctnagtgtccgtgtccccaggacaaacngccagcatcacctgctctgganataaatgacgagataaatatgctgcctggatcagcagaacgccaggccacgtcccctggtcggtgtcatctatcaagacaccaagccggcccgtggggactaccccgtgacgcgtattctctcggctcccaccgttgacgggaacncgacgcccactctacgacctaagtcgaggtacgggacgcgaggcgtggtggagttggacggggtctagttactttacgngtccgaggcggtaggactacggcgtacgcgtcggccggttcgggtcgggcggtaacgggaccagccgttacgaaccgtcgtcggcaccgccgaacgcgtccccgg

SEQ ID NO: 333671 - DNA, 528 bp, Homo sapiens
  misc_feature: GZ8MTXP01EGF8B.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (470)..(470): a, c, t, g, unknown or other
  misc_feature (470)..(470): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctgganataatgacgagataaantgctgctgatcagcagacgcaggccagtcccctggtggtgtcatctatacaagacaccgaaggccggcctacggggactaccccgtgagcgattctctgcctccacctgtcgggaacacgacgcccatctacgacccatcgaggccgggaacncgaggctgngagtcggagggtctagttctttagngtcgaggtcgtaggactgacgacgacgtcggccgttggtccgggnggacgggacccttaggcttcggaacccgtcgcggtacacgccgaacgggttctccccg

SEQ ID NO: 333672 - DNA, 628 bp, Homo sapiens
  misc_feature: GZ8MTXP01ADX5Z.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtcgtccccaggacaaacagccagcatcacctgctctggagataaattgacgaagataaatatgctgcctggatcagcagaacgccaggcctacgtccccgtggtggtcgtacatactactacaacgaccaaccgaaggcccggaccccgtacgggggactaccccgtggacgtcgtacttctccgtcggccctacccgacccttcgtaacggggaacaccgacgacccactcctacggacctacgccgagggaccgggacgcgaacgggctgggtaggagttcgggaggggttacgttgtttaccgtttacgtggtccgagggtcggtacgggacagggccacgcgttcggccggtttcgggaccgggcgggaaccggacgaacgttccgttccggtaacccgtccgtcggacccgccggttaccgaacccgttccgtcccccg

SEQ ID NO: 333673 - DNA, 636 bp, Homo sapiens
  misc_feature: GZ8MTXP01CAYCW.51.60.F05.1.454.CMB.2.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (500)..(500): a, c, t, g, unknown or other
  misc_feature (500)..(500): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtcgtccccaggacaaacngccagcatcacctgctcgtgganataaatgacgagaataaatatgctgcctggtatcagcagaacgccgacggcctacgtccccgtggtcggtggtctagtactatacgaacgaccaccgaacggcccggacccgtacggggactacccccgtggacgtcgtattccgtcgtcggcctccgtacctcgtacgggacacgacgccctactctcgacactcgacggacgggacgacgacgggcgtggtaggtacgtgggaacgggtcgtttaggtttacccgtttacggtcggtaccgngggtacgggtacggggactacggacgtaaccgtcgtcgggtcggttcgggtccggggacgggaacggacgaacggttccgttaccggtaacccgtccggtccgggtcaccggacccgtaacggttcccgtccccgg

SEQ ID NO: 333674 - DNA, 641 bp, Homo sapiens
  misc_feature: GZ8MTXP01B3T0F.51.60.F05.1.454.CMB.2.raw
  modified_base (202)..(202): a, c, t, g, unknown or other
  misc_feature (202)..(202): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcacctgctcgtggaagattaaattgacgaagaataaatatgctgcctggatcgagcaagaacgccgaggccacgtccccgtggtggtgtacatactatacaagaccaaccgacggccggcccgtcggggactacccgtggacgcgtacttcctcgtcggccctacctacccgtcgtacgggaaccacgacgccctactcacgtaccagtccgagggcccgggacgccgaggggtctggtagggagtcgggacggggtacgtttagtttaaccgtttttacgcgggtacggtcgggtcggtacggggacctacgggccgtacgtaccggttcgggtccgggttcgggtccggggacggggaaccggtacgacggttccgttaccggtcccggtccgtcgggtcgaccgacccggaacggttcccgtccccgg

SEQ ID NO: 333675 - DNA, 592 bp, Homo sapiens
  misc_feature: GZ8MTXP01CXUZO.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaatgcgagataaatatgctgcctggatcagcaagaacgccacggccagtcccctggtggtgtcatctatcaagacaccgaagccggccgtcggggactaccccgtggacgcgtacttcctcgtcggcctcccaccctcgtacgggaaccacgacgcccactctcgaccagtcgaggacgggacgcgacggctggtggagtggaggggtctaggttaccttttacgtgtcgtggcggtacgggacgtagccgacacggtcgggtccggttgggttccggggcgggtaacggggaaccgaacgggttccgttacgggaacccggttccgtccgggtccgaccgggacccgtaacgggcccgtcccccggg

SEQ ID NO: 333676 - DNA, 626 bp, Homo sapiens
  misc_feature: GZ8MTXP01C4MHL.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtcgtccccaggacaaacagccagcatcacctgctctggagataaattgacgaagaataaatatgctgcctggatcagcagagccgaggccacgtccctggtggtgtcatctatacaagaccaccgaggcccggaccgtcggggactaccccgtggacgcgtacttccgtccgtcggcctaccctacccgtcgtacgggaaccacgacgaccctactcgtacgaccatcgacggacgggacgcgacggcgtggaggtagtcggaggggtcttacggtttacctttacgtcggtacgacgggtcgggtacgggaccaggccgacgtacggtcggtcccgggttagggtcccgggacgggtaaaccggcccgttaacgggccttaccgggtaaccccggttcccgtcgggtaccgaccgccccgtaacgggccccgttcccccgg

SEQ ID NO: 333677 - DNA, 607 bp, Homo sapiens
  misc_feature: GZ8MTXP01E04UR.51.60.F05.1.454.CMB.2.raw
  modified_base (202)..(202): a, c, t, g, unknown or other
  misc_feature (202)..(202): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcagtgtccgtgtccccaggacaaacngccagcatcacctgctctggagataaattgacgagaataaatatgctgcctggatcagcaagaagccaggccagtcccctggtcggtggcatctatcaagacacaagccgccgtcggggactaccccgtgagcgtattcactggcctcccacgtacgtcgggaacacgacgccctactctacgaccagaccgaggaccggggacgccgggacggtcgttggtagggacgtggtacggggtacgttacggttacgtttacgttacggtcggtacgggtacgggtacgggacggacggaccggacgtacgtcggtccgggttcgggtcggggacggggaacgggaaccgacggttcggttaccggtcccggtcccgtccggtcgaccgaccgtaaccggccgtcccg

SEQ ID NO: 333678 - DNA, 637 bp, Homo sapiens
  misc_feature: GZ8MTXP01CSLAZ.51.60.F05.1.454.CMB.2.raw
  modified_base (202)..(202): a, c, t, g, unknown or other
  misc_feature (202)..(202): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtcgtccccaggacaaacngccagcatcactgctctggagataaattgagagaataaatatgctgcctggactacagcagaacgccgaggccacgtcccctggtcggtgctatctatacaagaccaccgaaggcccgaccgtcggggactaccccgtggacgcgtacttccgtacgttcggccctacccgaccgttacgtagggaaccacgacgccctacgtctacgaccagtccgacgggacgggacgacgacgggtcgtggtaggagtaggaacggggttcgttacggtttacttttacggtcggttacggacgggtcgggtacggggacgtacggaccgtaaccgtcggtcggtccgggttgggtaccggggacgggtaacgggccttaacggcccgttacggtaacccgtcggttccggacgaccggacccgtaacgttcccgtccccgg

SEQ ID NO: 333679 - DNA, 701 bp, Homo sapiens
  misc_feature: GZ8MTXP01B7Y2O.51.60.F05.1.454.CMB.2.raw
  modified_base (204)..(204): a, c, t, g, unknown or other
  misc_feature (204)..(204): n is a, c, g, or t
  modified_base (513)..(513): a, c, t, g, unknown or other
  misc_feature (513)..(513): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggattttgtggcctcctatgagctgattcagcccaccctcagtcgtccgtcgtccccaggacaaacngccagcatcacctgctcgtaggagtattaaattgacgaagtaataaatatgctgcctggtatcagcaagaacgccgaggccacgtccccgtggtggtcgtcacttctatacaaacgacaccgaacggccggacccgtacggggactaccccgtggacgcgtacttccgtcgttcggcctccgaccctcggtacgggaaccacgacgaccctactctacgaccagtacgacgggaccgggacgtcggacgggtcgttaggtaggtacgtacgggtacggggtcgtttacggtttaccgttttttaacggngggtttaccggaggggtaccgggttacgggggaacctaagggacccgtaaccgtccggttaacgggtcccggttcggggtttaccggggcgggtaaaccgggaccgaacggttccgttacccggtaaccggtcccgttaaccgggtccgaaccgggttacccgtaacgggttccccgttaaccccggg

SEQ ID NO: 333680 - DNA, 644 bp, Homo sapiens
  misc_feature: GZ8MTXP01EVW8G.51.60.F05.1.454.CMB.2.raw
  modified_base (201)..(201): a, c, t, g, unknown or other
  misc_feature (201)..(201): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtcgtccgtgtccccaggacaaacngccagcatcacctgctcgtaggagattaaagttgacgagaattaaatatgctgcctggtatcgagcaagacgccgacggccctagtccccgtggtcggtggtctatctatacaacgaccacgacgccggcccgtaggggactaccccgtgacgcgtatctactgcctccnctcgtggaaccncacgcccactcgtacgaccacgtcgacggcgggacgcgaggtcgtgtaggagtgggacgggtcttaggtacttttacgtcggtacgacgggtacggtagggacccgtcggaccgtaacccgtcgtcgggttccccggttggggttaccggggaccggggtaccgggaacccgttaaacggttcccggttacggaacccccggttcgtttaaccccgggtccggaacccggccccgtaaacggggttccccgttcccccggg

SEQ ID NO: 333681 - DNA, 727 bp, Homo sapiens
  misc_feature: GZ8MTXP01AHSNG.51.60.F05.1.454.CMB.2.raw
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
tcagcgatcgtatacacgaccggtgctcgatttagtacgtcatcagggaaaggggctgggcctcaggaagcagcatcgggaggtgcctcagccatggcatggatccctctcttcctcggcgtccttgcttactgcacaggattttgtggcctcctatgagctgattcagcccaccctcagtcgtccgtcgtccccaggacaaacngccagcatcacctgctctgganataatgacganataaatntgctgctggatcagcagacgcacggccacgtcccctggtggtgtcatctatacaacgaccaccgaacggcccggcccgtacgggggactaccccgtggacgtcgtattcgtcgtcggcctcccgacctcgtacgggaaccacgacgccctactcgtacgaacccagtccggacgggaccggggaaccgcggtaacggggtccgttagggtacgggtagttacgggtaacggggggttctttaacggggtttaacccttttttaaccgggtcgggttaccgggtaacggggtccggggttaagggggacccgtaacgggacccggtaaaccgtccgggttcgggtcccggggttcgggggttacccgggggaccgggggtaaaccggggaacccgttacgggttcccggttaccgggtaaccccggttccggtaaccgggtacccgacccgggaccccgtaacgggttccccgttcccccggg

SEQ ID NO: 333682 - DNA, 665 bp, Homo sapiens
  misc_feature: GZ8MTXP01BJ9BZ.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctctatgagctgattcagcccacctcagtcgtccgtcgtccccaggacaaacngccagcatcacctgctctgganataatgagagataaatatgctgcctggtatcagcaagacgccaggccacgtcccctgtggtgtcatctatcaagaccaccgaacggccggcccgtcgggggaactaccccgtggacgtcgtaactttcctcgttcggccctcccgtaacccgtcgtacggggaaaccaccgacgcccctaactcctacggaccctagtccgaggaccggggaccgcgacgggcgttagggtaggagttcgggaacgggggttctttacggttaacctttttaacggtcggtacggaacggggtcggttacggggacacgggtaccgaacgtccggttcgggtcccggttgggttaccgggggcgggaacggggtaacccaacgggttccgttacggaacccgttccggtccggtacgacccggacccgtaacgggttccccgttcccccggg

SEQ ID NO: 333683 - DNA, 736 bp, Homo sapiens
  misc_feature: GZ8MTXP01DE8DW.51.60.F05.1.454.CMB.2.raw
  modified_base (209)..(209): a, c, t, g, unknown or other
  misc_feature (209)..(209): n is a, c, g, or t
  modified_base (264)..(264): a, c, t, g, unknown or other
  misc_feature (264)..(264): n is a, c, g, or t
  modified_base (590)..(590): a, c, t, g, unknown or other
  misc_feature (590)..(590): n is a, c, g, or t
  modified_base (598)..(598): a, c, t, g, unknown or other
  misc_feature (598)..(598): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcagtcgtcccgtcgtacccccaggaaccaaacngccagccatccacctgctcgtaggaataattaaagttgacgaagtaattaaaatntcgactggcccttggtatcgaggccaaaggaacgcccgacggccctacggttcccccgtgggtcggtggtaccattactaactaccaaacggtaacccgaacccgtaaacggccccggggtacccccgttacggggggaaaccttaccccccggtaggaacggtccgtaacgtttcccgtaccgtcgggtcccttaccccgtaccccgttacggtaaccgggggaaacccaccggacaccccgacttccgtacgaccagtccgacggggcgggaccgcgagggtcctggtaggtaatcgggaggggttcttagttaccttttacgnggtaccgngggtcggtcgggacacgggtcaccgtaggtcgtcgggttggttccgggacgggtacggaaccgttaggttccgttacccgggtaacgttcccgtccgggttccaccgggttacccgtaacgggttccccgtccccggg

SEQ ID NO: 333684 - DNA, 825 bp, Homo sapiens
  misc_feature: GZ8MTXP01BFQIB.51.60.F05.1.454.CMB.2.raw
  modified_base (203)..(203): a, c, t, g, unknown or other
  misc_feature (203)..(203): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcacgcccaccctcagtcgtccgtgtccccaggacaaacncgccagcatcacctgctcgtaggagtataaagtgacgtaagtaattaaaactgtcggacttcggacccttagggtactacgacggacaaagggaaccggtccccgaacggtaccccgtaaccggtttccccccggttggggtttcggggttacggttacctaacgtttaccgtttaaactaccgaaaaccggtaaacccaaacccgggaaaccgggtccccggggtaccccggtacgggggtaaccttaacccccggtacggaacggtacccgtactttcccgttcgtacccgggtccctacccgtacccgttacgggtaccgggaaaccaccgacgacccctaaccttccggaacaaccccgagtccgaacgggggtacccggggacgtacggaacgggtcgttagggacggggtaaagttcgggacgggggtactttttacgggttacctttttaacgggcggttaaccggcggggtaccggtacgggaacgtcgggaccgtacgccggttaacggtcggggttacggtcggggaccggtaacgggaacacgggttccgttaccggtaaccccgttccgaacgggtcccgaccggcccgtaacggcccgttaacccccgg

SEQ ID NO: 333685 - DNA, 641 bp, Homo sapiens
  misc_feature: GZ8MTXP01AL3QY.51.60.F05.1.454.CMB.2.raw
  modified_base (176)..(176): a, c, t, g, unknown or other
  misc_feature (176)..(176): n is a, c, g, or t
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagccaccctnagtgtccgtgtccccaggacaaacngcagcatcacctgctctgganataatgacgagataaatatgctgctgatcagcagagccaggccagtccccgtgtggtggtcatctatcaagacaccgaagccggaccctcgggggactacccccgtggagcgtacttctctcggtcctcccacccgttcgacgggaaaccacacgtcccacgttctcggaacctagaccgagggccggggacgccgagggtccgtggttaggagttgggaacggggggtctaggtttaccttttaacgtcggttcgaacggggtccggttaggggaactacgggaccgaaccgtcggtcgggtcccggttgggggttacccgggcgggggaaaccggggaacccgttaagggcccgttacgggaaccccggttcggtccggtaccgaccggacccgtaacggttcccgtaacccccggg

SEQ ID NO: 333686 - DNA, 652 bp, Homo sapiens
  misc_feature: GZ8MTXP01DOBNW.51.60.F05.1.454.CMB.2.raw
  modified_base (202)..(202): a, c, t, g, unknown or other
  misc_feature (202)..(202): n is a, c, g, or t
  modified_base (463)..(463): a, c, t, g, unknown or other
  misc_feature (463)..(463): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcacctgctcgtggagtaataaattgacgaagaattaaatatgctgcctggtatcagcaagaacgccgaggccacggtcccctggtggtgtcatctatacaagaccaccgaagccggcccgtacggggactaacccccgtgacgcgtacttccgtcgtccgggtccctacccgtacccgtcgtacggggaaaccaccgaacggcccctaactcctacggaccagtccgaaggcgggaccgcgacgggcttgggnggtagtggacggggtcgttacggttactttttacgcggttcgacgggtcggttacgggacgtagccgactccggtcgtccggttcgggttacgggaccgggacgggtaacccaacgggttccttaaccgggtccccgtcccgttcgggtacccgaccggttaccccgaacgggttcccgtccccccggg

SEQ ID NO: 333687 - DNA, 610 bp, Homo sapiens
  misc_feature: GZ8MTXP01APWE9.51.60.F05.1.454.CMB.2.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngcagcatcactgctctgganataattgacgagataaatatgctgcctggatcagcagaagccgaggccacgtcccctggtggtggtcatctatacaagaccaaccgaaggccggcccgtacggggactaccccgtgacgcgtacttccgctacgggtccctacccgaccgtcgtacgggaaccacgacgcccactctacgaccgatcgacgggcggggacgcgaagggtcgtggcggtagttggaacggggtctaggttacctttacggtgtcggtagggtcggacgggacgtaggccgaaccgtcgtcggccggttgggtaccggggcgggtaacgggaacccgttagcccgttaccggtaacccgtcccggttcggcccgaccggacccgtaacggcccgttccccggg

SEQ ID NO: 333688 - DNA, 670 bp, Homo sapiens
  misc_feature: GZ8MTXP01BV707.51.60.F05.1.454.CMB.2.raw
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataatgcgagaataaatatgctgcctggatcagcagaacgccaggccacgtccccgtggtggtggtcatactatcaacgacaccgaacggccggcccgtcgggggactacccccgtggacgcgtactttcgtaccgtcggtcctcccgtaacccgtcgtacggggaaccacgacgaccctactccgtacgacctacgtaccgacggggtaccggggaccgcgtaacgggcgtgttacgggagtgggaacggggtcgttaggttaccttttacgtacgtcggacgggtcggtacgggacgcggtaccgcgtaccgtcggtcccgggttgggttcccgggggcggggtaaacgggacccgaaaccgggttccgttacccgggtaaccccggtttcccggtccgggtcccggtaccgggaccccggtaaccgggttcccgttccccccggg

SEQ ID NO: 333689 - DNA, 691 bp, Homo sapiens
  misc_feature: GZ8MTXP01B52Z0.51.60.F05.1.454.CMB.2.raw
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
tcagcgatcgtatacacgaccggtgctcgatttagtacgtcatcaggggaaagggggctgggcctcaggaagcagcatcggaggtgcctcagccatggcatggatccctctcttcctcggcgtccttgcttactgcacaggtatttgtggcctcctatgagctgattcagccaccctcagtgtccgtcgtccccgaggacaaacngccagcatcactgctgtganataatgacagataaatatgctagcctggtancagcagaacgccgacggccacgtcccctggtcgtgtctactctatacaagaccacgaacgcccggaccgtacggggactaaccccgtggagtaccgtacttcgtcgtcgggtcctcccgtaacccgtgtaaccgggaaccaccgacgacccctataccgacgaacacgtaccgaacgggaccgggacgcgtagggacgtggtaggagtacgggtaacggtcgttacggttaaccttttcgtacggttacggacggggttcggtaacggggaccgtaaggaccccgtaaacgtccggttccggtcccgggttcggggttaccgggggaaccggggtaaccggggaacccttaaacggggttcccttaccgggtaaccccgttacccggtcgggttacccgaccggttacccgaaccgggttcccgtaacccccggg

SEQ ID NO: 333690 - DNA, 596 bp, Homo sapiens
  misc_feature: GZ8MTXP01BYH3W.51.60.F05.1.454.CMB.2.raw
  modified_base (378)..(378): a, c, t, g, unknown or other
  misc_feature (378)..(378): n is a, c, g, or t
  modified_base (452)..(452): a, c, t, g, unknown or other
  misc_feature (452)..(452): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaatgacgagataaatatgctgcctggatcagcaagagccaggccagtcccctgtggtgtcatctatacaagacaaccaaggccggcccgtcggggactaccccgtggagcgtattctcgtggcctccacctcgtagggaacacagcccactcncgaccatcgagcgggacgcgaggctggtacggagtggacggggtcgttacggttaccgttttaacgtggtccgnggggtccggttacggggacctaggaccggaccgtacgtcggtcccggttcgggttcggggacggggacgggacccgaacggttccgttcggtaaccccgtccggttccggtccgacggttccccgaacggttccgttcccccgg

SEQ ID NO: 333691 - DNA, 631 bp, Homo sapiens
  misc_feature: GZ8MTXP01AL004.51.60.F05.1.454.CMB.2.raw
  modified_base (177)..(177): a, c, t, g, unknown or other
  misc_feature (177)..(177): n is a, c, g, or t
  modified_base (204)..(204): a, c, t, g, unknown or other
  misc_feature (204)..(204): n is a, c, g, or t
  modified_base (436)..(436): a, c, t, g, unknown or other
  misc_feature (436)..(436): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctnagtcgtccgtcgtccccaggacaaacngccagcatcacctgctcgtggatataaatgacgagataaatatgctgcctggatcagcagacgccgaggcctagtccccgtggtggtggtcatctactacaagaccaaccgaaggccggcccgtacgggggtactaccccgtggacgtcgtacttcctcgtcggtcctacccaccgttcgtacgggaaccacgacgccctacctcgtaccgaccagccgaggaccggggacncgacgggtcgtggtacggtagtggtacgggggtcttagggtttaaccttttacgcggttacgcgggacgggttacggaccgacggtaccgtaccacgggttcgtcccggttgggttccggggacgggaccgggtaaccacggttccgacggtaaccccgtccgtaacggcacggccccgtaagcccgtcccccgg

SEQ ID NO: 333692 - DNA, 678 bp, Homo sapiens
  misc_feature: GZ8MTXP01AS6ZV.51.60.F05.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtcgtccgtcgtcccaggacaaacngccagcatcacctgctcgtagganattaaagttgacgaagtaataaatatcgctcgcctaggtatcgagacgaagaacgccgacggccctacgtccccgtggtcggtcggtacagttactaagtaccaaacgaacccgaccgaacgggccggtcccggtacggggtactacccccgtaggacgtcgtacttccgtaccgtcggtcctacccgtaccgttacggtacgggaaccacgacgaccctacgtcctacgaccgtacgtaccgacgggaccggggacgcgtacgggtcgtgggtaggtagtcgggacggggttcgttacggtttaccgtttacggtcggtaccggagggtccgggtagggacgtacggaccgtacgtcggtcggtcgggttcgggtcgggacgggacggtaccgacggttcgttccggaacccgtcgtaacggtccgaccggccgtaacggttcccgtccccgg

SEQ ID NO: 333693 - DNA, 606 bp, Homo sapiens
  misc_feature: GZ8MTXP01EV5WK.51.60.F05.1.454.CMB.2.raw
  modified_base (331)..(331): a, c, t, g, unknown or other
  misc_feature (331)..(331): n is a, c, g, or t
  modified_base (457)..(457): a, c, t, g, unknown or other
  misc_feature (457)..(457): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgcgagaataaatatgctgcctggtatcagcagaacgccaggccacgtcccctggtggtggtcatctatcaagacaccgagccgcccgtcggggataccccnggagcgtattctctcgggcctcccaccgtcgtacgggtaaaccacgacgcccactctacgaccatcgacggacgggacgcgacgggctggtaggaagtggaacggggtcttagttaccttttacgngttccgagggtcggtagggacgtaggaccgtacgacgtcggtccggttcggggttccggggcgggaacgggtaccgaacggttccgttacgggtaacccgtccgttccgggaccgaccggaccccgtaacgggttcccgttcccccggg

SEQ ID NO: 333694 - DNA, 718 bp, Homo sapiens
  misc_feature: GZ8MTXP01B2VJR.51.60.F05.1.454.CMB.2.raw
  modified_base (178)..(178): a, c, t, g, unknown or other
  misc_feature (178)..(178): n is a, c, g, or t
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcacgcccaccctnagtcgtccgtcgtccccaaggaccaaacngccagcatcacctgctcgaggataataaactgacgaagaattaaatntcgctcgccgtaggtactcgagacaagacgtccgacggccctacgtccccgtggtcggtcgtactatctaataccgaacgacccaaccgaggcccggtacccggtaggggaccttaaccccgtggacgtccgtactttccgtcgtccggtcccctacccgacccgttcgggaaacggaaaccaccgaaccgtaccctacgttcgacggaacccacgtaccggacggggacccgggacgtacgacgggtcgttagggtacggagtacgggtacggggttcgtttaacggtttacccgttttaaggcggttaccgggacggggtccggtaacggggacctacgggcccgtaacgtcggtccgggtacccggttgggtacccggggacggacgggaacccaggttcccgttaccgggcccgttccggtaacccgcgaccgacccgggtaaccgttcccgtcccccgg

SEQ ID NO: 333695 - DNA, 607 bp, Homo sapiens
  misc_feature: GZ8MTXP01AUIJL.51.60.F05.1.454.CMB.2.raw
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (345)..(345): a, c, t, g, unknown or other
  misc_feature (345)..(345): n is a, c, g, or t
  modified_base (454)..(454): a, c, t, g, unknown or other
  misc_feature (454)..(454): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtcgtccgtcgtccccaggacaaacngccagcatcactgctctgganataatgacganataaatatgctgcctggtatcagcagaacgccaggccagtcccctggtggtggtcatctatacaagaccaccgaagccggccgtcggggactaccccgtgagcgtattctcncggtctcccactcgtagggaacacgacgcccactctacgaccatcgaggaccgggaacgcgagggtcgtgtagggatgggacggggtcgttaggttaccgtttttacgnggttcgacgggtccggtaggggaccgagaccgacgacgtcggtcccgggttggttccggggacgggaacgggaacccgaacgggttcccgttacgggtaaccccgtcccgttccgggtccaccggccccgaacgggttccccgttcccccggg

SEQ ID NO: 333696 - DNA, 832 bp, Homo sapiens
  misc_feature: GZ8MTXP01DAEWE.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcagtcgtcccgtcgtaccccgaggaaccaaacacgccagccatccacctgcctcgtaggagtaattaaagttgacgtaaagtaattaaaagttgtacgtcttacggcccgttaggtatccgagacgaaacggaacgccgacggccctacgttcccccgtggtcggtaggtctaacttacttaacgacgaaacgaccaaccgtacggaccccgggtcccgtacggggaccttacccccggtaggacggtcgtacgtttccgtaccgttcgggtccctccctaacccgtcgtacgggaaccaccgtacgccctacttctacggaccctacgtaccgaacggggaccgggtaccgcggaaccgggtgttaacgggtggtacgtacggtacggggggttaccgtttacgggtttaacctttttaccggagggtaccggtacgggggttcccgggtaaagggggtaccctacggggacccgtaaaccggtcccgggtttcgggaacccggggtttttcgggggtacccgggggaaccgggggtaaaccggggacccgttaaaccggttccggggttaccccgttaaacccgggttaccccgttccggggtaacccgaccggggaccccgttaaccggggttccccgtttaacccccccggg

SEQ ID NO: 333697 - DNA, 711 bp, Homo sapiens
  misc_feature: GZ8MTXP01B4SXI.51.60.F05.1.454.CMB.2.raw
  modified_base (200)..(200): a, c, t, g, unknown or other
  misc_feature (200)..(200): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctcgtgagataaatgacgagaataaatatgctgcctggatcagcaagaagcccaggccctacgtccccgtggtcggtggtacagtctatcgaaacgacaaccgaaggccggcccgtacgggggactaccccgtggacgtcggtactttccgtacgtccgggcccttaccccacccgttccgggtaacgggaaccccaacgacgtaccctaccgttctacgacccagtccgaagggccggggaacgtcgaacggccgttggtaggtagtagggacgggggtctttacggttaaccttttacggtcggtaaccgtggggtccgggtacggggtaaccgaggtaccgaaacctcggtaacgggtcccgggttggggtttacccgggggacggggtaaaccgggggaacaaccgggttccgttaccgggtaaccccggttcccggtaaccgggttcccgacccgggaccccggtaaacgggttccccgttaaccccccggg

SEQ ID NO: 333698 - DNA, 654 bp, Homo sapiens
  misc_feature: GZ8MTXP01EMAMD.51.60.F05.1.454.CMB.2.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (239)..(240): a, c, t, g, unknown or other
  misc_feature (239)..(240): n is a, c, g, or t
  modified_base (332)..(332): a, c, t, g, unknown or other
  misc_feature (332)..(332): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggattttgtggcctcctatgagctgattcagcccacctcagtcgtccgtgtccccaggacaaacngccagcatcacctgctcnganataatganagataaanngctgcctgatcagcaagacgccaggccagtcccctgtggtgtcatctatcaaagaccaacgacgtccggacccgtacggggacttaccccgnggacgcgtactttccgtacgtcgggcccttacccgaaacccgtttcgtacggggaaacccctacggacgtcccaacttcgtaccggaaccctagtcccgaagggacccgggaacgcgacgggtcgtaggtcggaagttgggaacggggtcttaggttacctttttaccgagttccgaacgggtccgttaacggggactacggacccggacacggttcggcccggttgggttacccggggacggtaaaccggggacttaaacggccgttacggtaaccccgtcgttaaccgggccaacggccccgaacggttcccgtccccgg

SEQ ID NO: 333699 - DNA, 818 bp, Homo sapiens
  misc_feature: GZ8MTXP01DO6DL.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctctatgagctgattcagcccaccctcagtcgtccgtcgtaccccgaggaacaaacgagccagcactcacctgcctcgtggaagataaagttgacgaagtaattaaaatagtcgtactggccgtaggtatcgaaggcaaggaacgcccggacggacccctacgtcccccgttggtcggtcggtcctaattacgtaactaccaaacgaaccaaccgaacggtcccggaccccggtacggggtacctacccgtacggacgtacgtacgtttccgtaccgttacggtccctacccgtacccgttaccggtaaccgggaaccgtaccgtacgaccctacccgttaccgtaccggaacccacgtaccggaacggggaccgggggaaccgggacggtaaccgggcggttagggtacggggtaacggttacgggacgggggtttaccgtttacgggttttaacccgttttttacggtaccgggttaccggttacgggggtaccggggttaccgggacggtacgggaccccgtaaccggttacccggtccgggttaccgggttccgggggttccggggaccggggtaaccgggggacccttaacgggttcccgttacccggtaaccccgggtccgtccggtccgacccggacccgggtaaccggcccgttcccccggg

SEQ ID NO: 333700 - DNA, 635 bp, Homo sapiens
  misc_feature: GZ8MTXP01D031N.51.60.F05.1.454.CMB.2.raw
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
  modified_base (487)..(487): a, c, t, g, unknown or other
  misc_feature (487)..(487): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccaccctcagtcgtcccgtcgtccccaggaccaaacngccagcatcactgctcgtgganataatgagaagataaatatgctgcctgatcagnaagagcgacggccagtcccctgtggtgtcatctatacaacgtacaccgaagcccggcccgtcggggactaccccgtgagtcgtatttccgtccgtcgggcctcccgaccctcgtacgggaaccacgacgtaccactcgtacacccagtcgacggacggggaccgcgacgggccgtagggtcggtagtacgggaacggggtcgtttaggttacctttttaaccgggnggtacggtacgggtcggtacgggacgtacggaccgtaccgtcggtcggtcgggttcgggtccggggaccgggaacgggtaccgcggttccgttacccggtccggtccggtccggccgaccggttacccgtaaccggttcccgtccccg

SEQ ID NO: 333701 - DNA, 556 bp, Homo sapiens
  misc_feature: GZ8MTXP01DWAHN.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (419)..(419): a, c, t, g, unknown or other
  misc_feature (419)..(419): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctgganataaattgcgaagaataaatatgctgcctggtatcagcaagaagccaggccagtcccctggtggtggtcatctatcaagacaccgaagccggcccgtgggggactaccccgtgagcgattcctacgtcgggcctccacccgtcgtacgggaaccacgacgcccactcgtacaccatcgaggacgggacgcgtacgggngtgtggtagtgaggggtacgttagttacgtttacgttcgtcgtaggcggtacgggacgtacggacgacgtcgtcggtcggttcggtcgggcgggacggacgacgcgttcgccgtcgtcgtcgcgaccgtcgcgtccg

SEQ ID NO: 333702 - DNA, 569 bp, Homo sapiens
  misc_feature: GZ8MTXP01DPRGR.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (391)..(391): a, c, t, g, unknown or other
  misc_feature (391)..(391): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctgganataaattgcaagataaanatgctgcctggtancagcaagagtccaggcagtcccctgtgtggtcatcatcaagacacaagtcgcctgggacttacccgngagctatcntcgcctacacgtacgacggaacactacgcctactcacgaccagtcgacggacggtacgacgngtacgtgtagtagtagtacgggtacgtacgttacgttacgtacgtcgtacggtacggtacggtacgtacgtacgtaccgacgtcggtcggttcggtcgggttacgggtacggtacggacgttcgttaccggtaaccgtccgtccgtccgtaccgttacccgtaaccggttccgtcccg

SEQ ID NO: 333703 - DNA, 636 bp, Homo sapiens
  misc_feature: GZ8MTXP01EUCG4.51.60.F05.1.454.CMB.2.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (460)..(460): a, c, t, g, unknown or other
  misc_feature (460)..(460): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtcgtccgtgtccccaggacaaacngccagcatcacctgctcgtgganataaattgacgagataaatntgctgcctaggatcagcaagaacgccaggccacgtccccgtggtcggtgtcattcgtatacaaacgaccaaccgaaggtcccggacccggtacggggactaccccgtaggacgtcgtactttccgtaacgtcgccctaccgtaccgtcggtacgggaactaccggactacccactcgtacgaccagtccgacggacggacgtcgagggcgttaggngacgtggacggtcttaggttacttttacgaggtccgagggttcgacgggacgtcggacgtaaccgcggtcggtccgggttcggggtaccggggacgggtacgggaaccgacgggttccttacccgggaaccggttccgtcgggtaccaccggacccgaacggttcccgtaaccccg

SEQ ID NO: 333704 - DNA, 725 bp, Homo sapiens
  misc_feature: GZ8MTXP01BL210.51.60.F05.1.454.CMB.2.raw
  modified_base (210)..(210): a, c, t, g, unknown or other
  misc_feature (210)..(210): n is a, c, g, or t
  modified_base (601)..(601): a, c, t, g, unknown or other
  misc_feature (601)..(601): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctctatgagctgattcacgcccaccctcagtcgtcccgtcgtaccccgaaggaaccaaacncgaccagcactccacctgcctcgtaggataattaaagttggacgaagtaattaaatgtacgtctgtaccgtaggtacacgacgacgaaggaaccgccgacggtccgtaccgttcccgtggtcggtcgtacactactatacgaacgaccaaccgacggcccggtaccgtacgggactcccgtgacgtctacttcctacggtcgtccctaccgaccgttcggaacggaaccaccgtacgccctacgtcgtaaccgacctacggtaccggaggggaccggaccgaggtccgggtagtagggtacggtaacgtggtaacgggggttctttaacggtttacgtttacggcgtacggacgggtcggtaacggccgtaacggccgtacgttaccgggngggttcccggttaggggaccggggacgggaaaccggtaccgttaacgggttccggttaccggaacccgggttccgtaacgggaccccacgggttacccggaacgggttccccgttaaccccggg

SEQ ID NO: 333705 - DNA, 701 bp, Homo sapiens
  misc_feature: GZ8MTXP01CDY3M.51.60.F05.1.454.CMB.2.raw
  modified_base (145)..(145): a, c, t, g, unknown or other
  misc_feature (145)..(145): n is a, c, g, or t
  modified_base (175)..(175): a, c, t, g, unknown or other
  misc_feature (175)..(175): n is a, c, g, or t
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgnggcctcctatgagctgattcagccaccctnagtgtccgtgtccccaggacaaangccagcatcacctgctctgganataatcgngagataaatatgctgccctggtaacncagacaagaacgtccgacggacctacgtcccgtggtcggtcgtactactactaactacgaaacgaccgaaccgacggtcccggtacccgtacggggtactaccccgtaggacgtcgtactttccgtaacgtccggtcccttacccgtaaccgtaccggtaacgggaaacccaccgtacgaccctacctcgtacgaccgtacgtacggacgggccgggacgacgacgggttcggtcggtacggtacgtacggtacggggtacgttacgtttaccgtttacgttacggtaccggtacgggtacgggtacgggacggtacggtaccggtaccgtacgtcggtccggttcgggtacgggaccgggtaaccgggtaaccggaccggttcggttccggtaacccggtccggtaaccggtaccgaccggacccggtaaccggttccggtcccg

SEQ ID NO: 333706 - DNA, 543 bp, Homo sapiens
  misc_feature: GZ8MTXP01D7T1Q.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (448)..(448): a, c, t, g, unknown or other
  misc_feature (448)..(448): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctgganataatgcgagataaantgctgcctggtatcagcagaagccgacggccacgtcccctggtcggtgtcacgttntatacgaagacgaccaaaggccggaccctggggactacccgtgacgtcgattctcgtagcctcctacctcgtagggaaccacngacccacgtntacggaccancgaggcggacgcgacgcgtgagagtcgtagggtcttcgttacttcgcgtcgnggcggtacggcgacggcacgtcgtcggcggttgggtcggacggacggacagcgttaccggtcccgtcgtccgcgacggacccgtcggccgtcccg

SEQ ID NO: 333707 - DNA, 688 bp, Homo sapiens
  misc_feature: GZ8MTXP01CM6FE.51.60.F05.1.454.CMB.2.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctnagtgtccgtgtccccaggacaaacngccagcatcacctgctctggagtataattgacgaagtaataaatatgctagtccttggactcgagcaagacgccgaggcctacgtcccctggtcggttcggtcattaccgtataccgaaacgaaccgaaccgtaacggcccgggtaccccggtcgggggtaacttaccccccgtgggacgtccggtacttttcccgtaccgttccgggtcccttaccccgtacccgtacggtacggggaaccaccgtacgacccctacgtctaccggtacccacgtaccgacggggaccgggtaacccggcggtaacgggtccgttagggtacgggtacgtacgggtaacgggggtcgtttacggtttaccttttaccggtcgtacgggacggtcgggtacggacgtacggaccgaccgtacgtcggtcgggttcgggtccgggcggtaacgggaccaggccgttacgcccgtcgtcgcgccgccgtgcccgtcccgg

SEQ ID NO: 333708 - DNA, 607 bp, Homo sapiens
  misc_feature: GZ8MTXP01BL5DT.51.60.F05.1.454.CMB.2.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (402)..(402): a, c, t, g, unknown or other
  misc_feature (402)..(402): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctggagataaattgcganataaatntgctgcctggtatcagcagagccaggccagtcccctgtggtgtcatctatcaaagacaccaaagccggaccctcggggactacccctgagtcgattcactggcttccgaacctcctagggaacctacgagtcccactctaggacctagtcaggtacggggcncgagggtctagtcgggattgacggggcgtagtaaccgtttttactacgggtcctaaggggccgttagggggacctagggacgtaccgtaacgtgtaccccggttgggttacggcggggtaacgggtacccaaacgggttcgttaccggtaacccggttccgttaacgggtcctacgggaccccgaaagggttccgtaaccccggg

SEQ ID NO: 333709 - DNA, 483 bp, Homo sapiens
  misc_feature: GZ8MTXP02JYQP5.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacccctgagcgattctctggctccacctctgggaacacagccactctgaccatcagcggacgcaggctgtgatgagctgactttactgtcaggcgtgggacagcgacactcgccgtgtcggcggaggaccagctgaaccgtctcggtcacgcccaggctcccgg

SEQ ID NO: 333710 - DNA, 481 bp, Homo sapiens
  misc_feature: GZ8MTXP02IZBNK.51.60.F05.1.454.CMB.2.raw
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (471)..(471): a, c, t, g, unknown or other
  misc_feature (471)..(471): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacccctgagcgattctctggctccacctctgggaacacagccactctgaccatcagcggacgcaggctgtggatgaggctgactttacngtcaggcgtggggacngcgacactgccgtgtcgggcggaggccaagctgaaccgtctcggtcngccagctccg

SEQ ID NO: 333711 - DNA, 476 bp, Homo sapiens
  misc_feature: GZ8MTXP02GV4YB.51.60.F05.1.454.CMB.2.raw
  modified_base (403)..(403): a, c, t, g, unknown or other
  misc_feature (403)..(403): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggcctcggggatacccctgagcgattctctggctccactctgggaacacagccactctgaccatcagcggacgcaggctgtgatgagctgactttacngtcaggcgtggacagcgacactgccgtgtcggcggaggaccaagctgaaccgtctcggtcagcccaggctccg

SEQ ID NO: 333712 - DNA, 487 bp, Homo sapiens
  misc_feature: GZ8MTXP02HXP20.51.60.F05.1.454.CMB.2.raw
  modified_base (334)..(334): a, c, t, g, unknown or other
  misc_feature (334)..(334): n is a, c, g, or t
  modified_base (407)..(407): a, c, t, g, unknown or other
  misc_feature (407)..(407): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacccctgagcgattcnctggctccactctgggaacacagcccactctgaccatcagcggacgcaggctgtgatgaggctgacttttacngtcaggcgtgggacagcgacacgtcgccgtgttcggcggagggaccaagctgaaccgtctcggtcagcccaaggctccgg

SEQ ID NO: 333713 - DNA, 491 bp, Homo sapiens
  misc_feature: GZ8MTXP02J0KQ0.51.60.F05.1.454.CMB.2.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagntaaattgcgagataaatatgctgcctggtatcagcagaagccaggccagtcccctgtggtggtcatctatcaagacacaagcggccctcggggatacccctgagcgattctctggctccacctctgggaacacagcccactctgaccatcagcgggacgcaggctgtggatgaggctgtactttactgtcaggcgtgggacgagcggacacgtgcgtgtcggcggagggaccagctgaaccgtctcggtcagcccgaaggcctcccgg

SEQ ID NO: 333714 - DNA, 504 bp, Homo sapiens
  misc_feature: GZ8MTXP02IAN8X.51.60.F05.1.454.CMB.2.raw
  modified_base (277)..(277): a, c, t, g, unknown or other
  misc_feature (277)..(277): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtccccngtggtggtcatctatcaagacaccaagcggccctcggggataccccctgagcgattctctggctccacctctgggaaccacagcccactctcgaccatcagcgggacgcaggctgtgatgaggctgtactttacgngtcaggcgtgggacngcgacactcgccgtgttcgggcggacgggaccaacgctcggaacccgtccgtcggtccagccccaaggcctcccgg

SEQ ID NO: 333715 - DNA, 489 bp, Homo sapiens
  misc_feature: GZ8MTXP02G4KZC.51.60.F05.1.454.CMB.2.raw
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagcggccctcggggataccccgtgagcgattctctggctccactctgggaacacagcccactctgaccatcagcgggacgcaggctgtggatgaggctgactttacngtcaggcgtgggacngcgacactcgcgtgtcggcggacggaccacgctgaaccgtctcggtcacgccctaggctcccg

SEQ ID NO: 333716 - DNA, 514 bp, Homo sapiens
  misc_feature: GZ8MTXP02JPC9A.51.60.F05.1.454.CMB.2.raw
  modified_base (424)..(424): a, c, t, g, unknown or other
  misc_feature (424)..(424): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggataccccgtgagcgattctctggcctccactcgtaggggaacacacgccctactctcgaccatcagcgggacgcaggctaggtggatggaggtctgtacttttacgngtcgaggcgtgggacagcgacacgtcgccgtggtcggcggacgggaccaaggctacgaaccgtccgtacggcacgccaacggcctcccgg

SEQ ID NO: 333717 - DNA, 515 bp, Homo sapiens
  misc_feature: GZ8MTXP02IFTI3.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (415)..(415): a, c, t, g, unknown or other
  misc_feature (415)..(415): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaatgcganaataatatgctgcctggtatcagcagaagccaggccagtcccctgtggtggtccatctatcaaagacacaagccggcccctggggataccccgtgacgcgattctctggctcccactctgggaaccncagcccactcngaccatcagcgggacgcaggctggtgatgaggctgtacttttangtcgaggtcgtgggacagcgacacgtcgccggttggtcggcggacgggaccaagccaggaacccgtcccgtacggccaacgccccgaaggccctccccgg

SEQ ID NO: 333718 - DNA, 515 bp, Homo sapiens
  misc_feature: GZ8MTXP02I8YQ9.51.60.F05.1.454.CMB.2.raw
  modified_base (199)..(199): a, c, t, g, unknown or other
  misc_feature (199)..(199): n is a, c, g, or t
  modified_base (273)..(273): a, c, t, g, unknown or other
  misc_feature (273)..(273): n is a, c, g, or t
  modified_base (448)..(448): a, c, t, g, unknown or other
  misc_feature (448)..(448): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagagcagccagtcccngtgtggtcatctatcaagacacaagcgcccgtcggggataccccgtgagcgattctctcggcctccacctcgtagggaacacgacgcccactctcgaccatcaggcgggacgcgaggcgtagtggatggagggtcttaggtacttttacgtgtccgaggcgtgggacaggcgacncgtcggccgtggtccgggcggacgggaccgaacgcgtcgaaccgtcgcggtcacgccgacgctcccg

SEQ ID NO: 333719 - DNA, 499 bp, Homo sapiens
  misc_feature: GZ8MTXP02GZW6Q.51.60.F05.1.454.CMB.2.raw
  modified_base (335)..(335): a, c, t, g, unknown or other
  misc_feature (335)..(335): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctggtggtggtcatctatcaagacacaagcgccctcggggataccccgtgagcgattcnctggctccactcgtgggaacacacgcccactctcgaccatcagcgggacgcgaggctggtggatggaggctgtacttttagtgtcgaggcggtgggacagcgacacgtgccggtgtcgggcggacggacgaacgctgaaccgtcgcggtcacgccacgctcccg

SEQ ID NO: 333720 - DNA, 505 bp, Homo sapiens
  misc_feature: GZ8MTXP02F72P3.51.60.F05.1.454.CMB.2.raw
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcgcctcggggataccccgtgagcgattctctggcctccacctcgtacgggaaccacagcccactctagaccatcagcgggacncgaggctgtgatgaggctgtactttacgngtcgaggcgtgggacagcgacactcgccggtgtcggcggacgggaccaacgctcgaaccgtccgtcggtcacgacccacggctcccgg

SEQ ID NO: 333721 - DNA, 511 bp, Homo sapiens
  misc_feature: GZ8MTXP02FWTVY.51.60.F05.1.454.CMB.2.raw
  modified_base (338)..(338): a, c, t, g, unknown or other
  misc_feature (338)..(338): n is a, c, g, or t
  modified_base (416)..(416): a, c, t, g, unknown or other
  misc_feature (416)..(416): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagccggcctcggggataccccgtgacgcgattcnctggcctccacctctcgggaacacacgcccactctcgaccatcagcgggacgcgaggctgtgatgagctgactttacngtcaggcgtgggacagcgacacgtcgccgtgttccggcggacggaccgaacgctacggaacccgtccgtcggtccacgcccgaacggctccccgg

SEQ ID NO: 333722 - DNA, 491 bp, Homo sapiens
  misc_feature: GZ8MTXP02HPDF4.51.60.F05.1.454.CMB.2.raw
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtgtggtcatctatcaagacacaagcgccctcggggatacccctgagcgattctctggctccactcgtgggaacacagccactctgaccatcagcggacgcaggctgtgatggagctgacttttacgngtcgaggcgtgggacagcganacgtcgccggtgtcggcggacggaccgaagctgaaccgtctacggtcagcccaacggctcccgg

SEQ ID NO: 333723 - DNA, 486 bp, Homo sapiens
  misc_feature: GZ8MTXP02GMF80.51.60.F05.1.454.CMB.2.raw
  modified_base (381)..(381): a, c, t, g, unknown or other
  misc_feature (381)..(381): n is a, c, g, or t
  modified_base (467)..(467): a, c, t, g, unknown or other
  misc_feature (467)..(467): n is a, c, g, or t
tcagcgatcgtatacacgaccggtgctcgatttagtacgtcatcagggaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagcggccctcggggatacccctgagcgattctctggctccacctctgggaacacagccactctgaccatcagcgggacncaggctgtggatggaggctgactttactgtcgaggcgtgggacagcgacactgccgtgtcggcggagggaccaagctgaacgtccncggtcacgccacggctccg

SEQ ID NO: 333724 - DNA, 495 bp, Homo sapiens
  misc_feature: GZ8MTXP02JFJVK.51.60.F05.1.454.CMB.2.raw
  modified_base (222)..(222): a, c, t, g, unknown or other
  misc_feature (222)..(222): n is a, c, g, or t
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataatatgctgcctggtatcagcagaagccaggccagtcccctgtggtggtcatctatcaagacaccaagcgcctcggggatacccctgagcgattctctggctccactctgggaacncagccactctgaccatcagcggacgcagctagtgatgaggctgactttacgngtcgaggcgtgggacaggcgacacgtgccgtgttccgggcggacggaccaagctacggaaccgtcgtcggtcacgcccgaaggctccccgg

SEQ ID NO: 333725 - DNA, 500 bp, Homo sapiens
  misc_feature: GZ8MTXP02HJ1JL.51.60.F05.1.454.CMB.2.raw
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
  modified_base (412)..(412): a, c, t, g, unknown or other
  misc_feature (412)..(412): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaatgcgagataaatatgctgcctggtatcagcagaagccaggccagtcccctgtggtggtcatctatcaagacaccaagcggccctcggggatacccctgagcgattcnctggctccactctgggaacncagcccactctgacccatcagcgggacgcaggctgtggatgaggctgtacttttacngtcaggcgtgggacagcgacacgtgccgtgtcgggcggacgggaccaagctcggaaccgtccgtcggtcacgcccgaaggcctcccgg

SEQ ID NO: 333726 - DNA, 509 bp, Homo sapiens
  misc_feature: GZ8MTXP02GSWX0.51.60.F05.1.454.CMB.2.raw
  modified_base (222)..(222): a, c, t, g, unknown or other
  misc_feature (222)..(222): n is a, c, g, or t
  modified_base (423)..(423): a, c, t, g, unknown or other
  misc_feature (423)..(423): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggtatcagcagaagccaggccagtcccctggtggtggtcagtctatcaagacaccaagccggccctcggggactaccccgtgagcgattctctgggcctccactcgtcgggaacacgagcccactctacgaccatcagcgggacgcaggctgtggatgaggctgtactttacgngtcgaggcgtggacagcgacactcggccgtggttcggcggacggacaacgcgtcgaaccgtctcggtcacgcccgacggctcccgg

SEQ ID NO: 333727 - DNA, 529 bp, Homo sapiens
  misc_feature: GZ8MTXP02H8XXI.51.60.F05.1.454.CMB.2.raw
  modified_base (430)..(430): a, c, t, g, unknown or other
  misc_feature (430)..(430): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgacgagataaatatgctgcctggtatcagcagagccaggccagtcccctggtggtggtcatctatcaagacacaagccggccgtggggactaccccgtgagcgattctcgtcgcctccactcgtagggaacacgagcccactcacgaccatcgagcgggacgcgaggcgtggtaggactggaggtcttgtactttttacggngtcgaggtcggtaggacaggccgacgcgtcgcggtggtcggacgggacgacgacgcgtacgaacccgtcgacggtacgaccgaccgacggtccgtcccg

SEQ ID NO: 333728 - DNA, 488 bp, Homo sapiens
  misc_feature: GZ8MTXP02H0TDW.51.60.F05.1.454.CMB.2.raw
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggcccctggggatacccctgagcgattctctggctccactctgggaacncagcccatctgaccatcaagcgggacgcaggctgtggatggaggctgtaccttttangtcaggcgtgggacagcgacacgtcgccgttgtcggcggacggccaagctgaaccgtctcggtcagcccaggctccg

SEQ ID NO: 333729 - DNA, 516 bp, Homo sapiens
  misc_feature: GZ8MTXP02J39OK.51.60.F05.1.454.CMB.2.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagcccaccctcagtgtccgtgtcccaggacaaacngccagcatcacctgctctggagntaaattgcgagataaatatgctgcctggtatcagcagaagccaggccagtcccctgtgtggtcatctatcaagacaccacgcggccctcgggatacccctgagcgattctcttggctccacctctggaacncagccactctgaccntcagcggacgcgaggcgtgtggagtgtaggcgtgtacttacgttctcgtcgagggcgacggggacacgcgacgtcgcggtccgtcgttcggggcgtacgacgacggaccgaacgtccgtcgtcccgtccgccgtacgaccgtccccgg

SEQ ID NO: 333730 - DNA, 500 bp, Homo sapiens
  misc_feature: GZ8MTXP02JXZAQ.51.60.F05.1.454.CMB.2.raw
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (390)..(390): a, c, t, g, unknown or other
  misc_feature (390)..(390): n is a, c, g, or t
  modified_base (409)..(409): a, c, t, g, unknown or other
  misc_feature (409)..(409): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagcggccctcggggatacccctgagcgattcnctggctccactcgtgggaacncagccactctgacccatcagcggacgcagctgnggatgagctgtactttacngtcaggcgtgggacaggcgacacgtcgcccggtggttcggcggacgggaccaagcgtcgaaccgtccgtcggtcgagcccaaggctcccgg

SEQ ID NO: 333731 - DNA, 579 bp, Homo sapiens
  misc_feature: GZ8MTXP02JS00E.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaacgccaggccagtcccctgtggtgtcatctatacaagacaccgaagccggcccgtcggggactaccccgtgacgcgtattctctcggcctccacctcgtagggaacacacgcccactctacgaccatcgagcgggacgcgaggctgtaggatggaggctagttacttttacgtgtacgacgggtcggtcggggaacacggaccgactacgtcggcccggttgggtccggggacgggacgggacccgaaacggtcccgtacggtaaccccggttcccgtaccgggtaccgaccggaccccgaacggtcccgtcccccgg

SEQ ID NO: 333732 - DNA, 504 bp, Homo sapiens
  misc_feature: GZ8MTXP02JCI5L.51.60.F05.1.454.CMB.2.raw
  modified_base (200)..(200): a, c, t, g, unknown or other
  misc_feature (200)..(200): n is a, c, g, or t
  modified_base (415)..(415): a, c, t, g, unknown or other
  misc_feature (415)..(415): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaagccaggccagtcccctgtggtggtcatctatcaagacaccaaagcggccctcggggataccccgtgagcgattctctggctccacctcgtgggaaccacacgcccactctgaccatcagcggacgcaggctgtggatgaggctgtactttacngtcgaggcgtgggacagcgacacgtgccgtgttcggcggacggaccgaacgcgacgaaccgctccggtcacgcccgaacggccgtcccg

SEQ ID NO: 333733 - DNA, 522 bp, Homo sapiens
  misc_feature: GZ8MTXP02HL589.51.60.F05.1.454.CMB.2.raw
  modified_base (200)..(200): a, c, t, g, unknown or other
  misc_feature (200)..(200): n is a, c, g, or t
  modified_base (277)..(277): a, c, t, g, unknown or other
  misc_feature (277)..(277): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (484)..(484): a, c, t, g, unknown or other
  misc_feature (484)..(484): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagagccaggccagtccccngtggtggtcatctatcaagacacaagcggccctcggggatacccctgagcgattctctggctccacctcgtaggggaaccacgacgcccaactctcgaccatcagcgggacgcgaggtctggngatggaggcttgacttttacgngtcagggcgtgggacagcgacacgtcggccgttggttccgggacgggacgggaccgaaggcncggaacccgtctcggcacggccccaagggcctccccgg

SEQ ID NO: 333734 - DNA, 556 bp, Homo sapiens
  misc_feature: GZ8MTXP02FRR3M.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctggtggtggtcatctatcaagacaccaagccggccctcggggataccccgtgagcgattcctcgtggcctcccacctcgtacgggaaccacacgcccactctacgaccatcgaaggcgggacgcgaggctggtggagtggaggtctgtacttttacgtgttccgaggcggtgggacaggcgacgactcggtcccggtggttccgggacgggacgggaccgaacggccgttacggaacccggtccgtacgggtccacggacccgaacgggcctaccccgg

SEQ ID NO: 333735 - DNA, 519 bp, Homo sapiens
  misc_feature: GZ8MTXP02IZ4H8.51.60.F05.1.454.CMB.2.raw
  modified_base (200)..(200): a, c, t, g, unknown or other
  misc_feature (200)..(200): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagagcaggccagtcccctgtgtggtcatctatcaagcacaagcgccctcggggataccctgagcgattctctggctccacctcgtgggaaccacacgccactctcgaccatcgagcgggacncgaggctgtgatgaggctgacttttangtccgaggcggtggaacngcgacactggccgttggttcgggcggtacgggaccgtaaaggccgtacggaacccgtccgtccggtaccacggaccccgaacggccttccccgg

SEQ ID NO: 333736 - DNA, 484 bp, Homo sapiens
  misc_feature: GZ8MTXP02G2FQ0.51.60.F05.1.454.CMB.2.raw
  modified_base (337)..(337): a, c, t, g, unknown or other
  misc_feature (337)..(337): n is a, c, g, or t
  modified_base (389)..(389): a, c, t, g, unknown or other
  misc_feature (389)..(389): n is a, c, g, or t
  modified_base (409)..(409): a, c, t, g, unknown or other
  misc_feature (409)..(409): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagcgcctcggggataccccgtgagcgattctcnggctccactctgggaacacagcccactctgacccatcagcgggacgcaggcngtgatgaggctgacttttangtcaggcgtgggacagcgacactgccgtgtcggcggaggaccaagctgaaccgtctcggcacgccaaggctcccg

SEQ ID NO: 333737 - DNA, 498 bp, Homo sapiens
  misc_feature: GZ8MTXP02IZE4R.51.60.F05.1.454.CMB.2.raw
  modified_base (276)..(276): a, c, t, g, unknown or other
  misc_feature (276)..(276): n is a, c, g, or t
  modified_base (333)..(333): a, c, t, g, unknown or other
  misc_feature (333)..(333): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgcgagataatatgctgcctggtatcagcagaagcaggccagtccccngtggtggtcatctatcaagacaccaagcggccctcggggatacccctgagcgattcnctggctccactctgggacacagcccactctgaccatcagcgggacncgaggctgtgatgaggctgtactttangtccaggcgtgggacagcgacacgtcgcgttggttccggcggacggaccgaagctacgaaccgtccgtcggtcacgcccgaaggcctcccgg

SEQ ID NO: 333738 - DNA, 505 bp, Homo sapiens
  misc_feature: GZ8MTXP02HYLKE.51.60.F05.1.454.CMB.2.raw
  modified_base (200)..(200): a, c, t, g, unknown or other
  misc_feature (200)..(200): n is a, c, g, or t
  modified_base (328)..(328): a, c, t, g, unknown or other
  misc_feature (328)..(328): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagtcaccctcagtgtccgtgtccccaggacaaacngccagcatcacctgctctggagataaattgcgagataaatatgctgcctggtatcagcagaagccaggccagtcccctgtggtggtcatctatcaagacaccaagccggccctggggatacccctgancgattctctggctccacctctcgggaacncgagcccactctgaccatcagcgggacgcgaggctgtggatgaggctgtactttangtcgaggcgtgggacagcgacacgtcgccgtggtcggcgggacgggaccaagcgtcgaaccgtccgtcggtcgacgcccgaaggcctcccgg

SEQ ID NO: 333739 - DNA, 506 bp, Homo sapiens
  misc_feature: GZ8MTXP02FS9DR.51.60.F05.1.454.CMB.2.raw
  modified_base (402)..(402): a, c, t, g, unknown or other
  misc_feature (402)..(402): n is a, c, g, or t
  modified_base (441)..(441): a, c, t, g, unknown or other
  misc_feature (441)..(441): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagccggcctcggggataccccgtgacgcgattctctgggcctcccacctcgtacgggaaccacagcccactctcgaccatcagcgggacgcaggctgnggatgaggctgtacttttacgtgtcgaggcggtgggacngacgacacgtgccgtgttcggcggacggacagcgtgaaccgtcgtcgtcacgcccagcctcccgg

SEQ ID NO: 333740 - DNA, 511 bp, Homo sapiens
  misc_feature: GZ8MTXP02GGHWU.51.60.F05.1.454.CMB.2.raw
  modified_base (222)..(222): a, c, t, g, unknown or other
  misc_feature (222)..(222): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggtatcagcagaagccaggccagtcccctgtggtggtcatctatcaagacaccaagcggccctggggactaccccgtgagcgattctctggcctccacctcgtagggaaccacagcccactctgaccatcagcggacgcgaggctgtgatgaggctgacttttacngtcgaggcgtgggacngcgacactcggccgtggttcggcggacgggaccaagccgtagaacccgtccgtcggtaccacgaccgaacggctccccgg

SEQ ID NO: 333741 - DNA, 525 bp, Homo sapiens
  misc_feature: GZ8MTXP02H0WQZ.51.60.F05.1.454.CMB.2.raw
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgacgagataaatatgctgcctggtatcagcagagccaggccagtcccctggtgtggtcatctatcaagacaaccaagccggccctcggggatacccccgtgacgtcgattctcgtcggctcccactccgtagggaaccncagcccactctcgacatcagcggacgngaggctgngatgagtntgtactttacngtcgaggcgtggacaggcgaacncgtcgcggttggtcgggcgggaacgggccaaacggccacggcccgtcccgtaggtccgacgcccgaacgggcctccccgg

SEQ ID NO: 333742 - DNA, 514 bp, Homo sapiens
  misc_feature: GZ8MTXP02G9UKT.51.60.F05.1.454.CMB.2.raw
  modified_base (341)..(341): a, c, t, g, unknown or other
  misc_feature (341)..(341): n is a, c, g, or t
  modified_base (404)..(404): a, c, t, g, unknown or other
  misc_feature (404)..(404): n is a, c, g, or t
  modified_base (442)..(442): a, c, t, g, unknown or other
  misc_feature (442)..(442): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctggtggtggtcatctatcaagacaccaaagccggccctcggggactaccccgtgacgcgattcnctggcctccacctcgtagggaaccacgagcccactctacgaccatcgagcgggacgcgaggcngtggatggaggctgtactttactgcgaggcgtgggacngcgacacgtgccgtggtcggcgggacgaccgaacgcgcgaaccgtcgtcggtcacgaccgacggcctcccgg

SEQ ID NO: 333743 - DNA, 542 bp, Homo sapiens
  misc_feature: GZ8MTXP02IKXH0.51.60.F05.1.454.CMB.2.raw
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagaataaatatgctgcctggtatcagcagaagccaggccagtcccctgtggtggtcatctatcaagacaccaagccggccctcggggataccccgtgagcgattctctggctccacctcgtggaaccacagccactcngaccatcagcggacgcaggctggngagtgaggtcttagttactttacgtgtcgagggtcggtagggacgaggacgacgtacgtcggtccggttcgggtcggggacgggaacgggaccgaacggtcgtacggtaaccgtccgtacggtccacggacccgtacggccgtcccgg

SEQ ID NO: 333744 - DNA, 524 bp, Homo sapiens
  misc_feature: GZ8MTXP02HJVNS.51.60.F05.1.454.CMB.2.raw
  modified_base (200)..(200): a, c, t, g, unknown or other
  misc_feature (200)..(200): n is a, c, g, or t
  modified_base (394)..(394): a, c, t, g, unknown or other
  misc_feature (394)..(394): n is a, c, g, or t
  modified_base (440)..(440): a, c, t, g, unknown or other
  misc_feature (440)..(440): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataatgcgagataaatatgctgcctggtatcagcagaagccaggccagtcccctgtggtggtcatctatcaagacacaagccgcctcggggataccctgagcgattctctggcctccacctcgtacgggaaccacgacgcccactctcgaccatcagcgggacgcaggctgnggatggaggcttagtacttttacgtgttcgagggtcggtagggacnggacgacacgtcgccggttggttcgggcgggacgggaccacggcgtcggaacccgtcgtcggtccacgcccgaaggcctcccgg

SEQ ID NO: 333745 - DNA, 532 bp, Homo sapiens
  misc_feature: GZ8MTXP02GP232.51.60.F05.1.454.CMB.2.raw
  modified_base (200)..(200): a, c, t, g, unknown or other
  misc_feature (200)..(200): n is a, c, g, or t
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgacgagataaatatgctgcctggtatcagcagaagccaggccagtcccctgtggtggtcatctatacaagacaccgaagccggccctcggggactaccccgtgacgcgacttctcgtcgggcctccacctcgtaggggaaccacacgcccactctacgaccatcgagccgggacgcgaggctgnggatggaggctgtactttacgngtcgaggcgtagggacagcgacacgtcggccgtggtcgggcgggacggaccgacgcctacggcccgtccgtcggtccacgacccgacggcctcccgg

SEQ ID NO: 333746 - DNA, 478 bp, Homo sapiens
  misc_feature: GZ8MTXP02HMBA0.51.60.F05.1.454.CMB.2.raw
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
  modified_base (459)..(459): a, c, t, g, unknown or other
  misc_feature (459)..(459): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacacaagcgccctcggggatacccctgagcgattctctggctccactctgggaacacagccactctgaccatcagcgggacgcaggctgtgatgaggctgactttacngtcaggcgtggacagcgacactgcgtgttcggnggaggccaagctgaaccgtcncggtcagcccaaggctccg

SEQ ID NO: 333747 - DNA, 520 bp, Homo sapiens
  misc_feature: GZ8MTXP02FWY26.51.60.F05.1.454.CMB.2.raw
  modified_base (200)..(200): a, c, t, g, unknown or other
  misc_feature (200)..(200): n is a, c, g, or t
  modified_base (397)..(397): a, c, t, g, unknown or other
  misc_feature (397)..(397): n is a, c, g, or t
  modified_base (421)..(421): a, c, t, g, unknown or other
  misc_feature (421)..(421): n is a, c, g, or t
  modified_base (440)..(440): a, c, t, g, unknown or other
  misc_feature (440)..(440): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaagccaggccagtcccctgtggtggtcatctatcaagacaccaagccggcctcggggactacccctgagcgattctctggctccacctctgggaaccacacgcccactctgaccatcagccgggacgcgacggctgnggatggaggtctgtacttttacgngtccgagggcgtggggacngacgacacgtcgccggtgttcgggacggacggggaccaaggctcgaaccgtcctacggtcacgtcccgaaggcctcccgg

SEQ ID NO: 333748 - DNA, 496 bp, Homo sapiens
  misc_feature: GZ8MTXP02H7XJJ.51.60.F05.1.454.CMB.2.raw
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
  modified_base (461)..(461): a, c, t, g, unknown or other
  misc_feature (461)..(461): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaatgcgagataaatatgctgcctggtatcagcagaagccaggccagtcccctgtggtgtcatctatcaagacaccaagccggccctcggggatacccctgagcgattcnctggcctccactcgtaggacacagcccactcngacccatcagccgggacgcgaggctgtggatggaggctgtactttacngtcaggcgtgggacagcanactgccgtgtcggcggacggaccagcncgaaccgtcgtcggtcacgcccgaaggtctcccgg

SEQ ID NO: 333749 - DNA, 507 bp, Homo sapiens
  misc_feature: GZ8MTXP02JYA2P.51.60.F05.1.454.CMB.2.raw
  modified_base (200)..(200): a, c, t, g, unknown or other
  misc_feature (200)..(200): n is a, c, g, or t
  modified_base (336)..(336): a, c, t, g, unknown or other
  misc_feature (336)..(336): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtctttgcttactgcacaggatttgtggcctcctatgagctgattcagccaccctcagtgtccgtgtccccaggacaaacngccagcatcacctgctctggagataaattgcgagataaatatgctgcctggtatcagcagagccaggccagtcccctgtggtggtcatctatcaagacaccaagccggccctcggggataccccgtgagcgattcnctggctccacctcgtgggaacacacgccactctgacccatcagggggcgacgcgaggctgtgganggagctgtactttacngtcagggcgtgggacnggcgacgactgcccgtggtcggcgggacggaccagcgtgaaccgtcccgtcgggtcacggcccaggcctcccgg

SEQ ID NO: 333750 - DNA, 503 bp, Homo sapiens
  misc_feature: GZ8MTXP02GJM0X.51.60.F05.1.454.CMB.2.raw
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacccctgagcgattctctggctccacctctgggaacacagcccactctgaccatcagcgggacncaggctgnggatgaggctgacttttacngtcaggcgtggggacagcgacacgtcgccggtggttcggcggagggaccaagcgtgaacccgtcgtcggtcacggcccaagggcctacccgg

SEQ ID NO: 333751 - DNA, 497 bp, Homo sapiens
  misc_feature: GZ8MTXP02GA8P2.51.60.F05.1.454.CMB.2.raw
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggatcagcagaanccaggccagtcccctgtggtggtcatctatcaagacacaaagcggcctcggggatacccctgagcgattctctggcctccacctcgtgggaacacagccactctcgacactcagcggacgcgaggcngtggatgaggctgactttacngtcaggcgtggggacagacgcactcggccgtgttcgggcggacgggaccacggctgaaccgtcgtcggtcacgccgaaggctcccgg

SEQ ID NO: 333752 - DNA, 559 bp, Homo sapiens
  misc_feature: GZ8MTXP02F6EFB.51.60.F05.1.454.CMB.2.raw
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggtatcagcagaagccaggccagtcccctggtggtggtcatctatcaagacaccgaagccggcccgtcggggactaccccgtgacgcgtattcgtctggcctccacctcgtacgggaccacacgccactcctcgaccatcaggaccggggacgcgacgggtctggtggtaagtggaggtcgttagttacttttacgtgtaccgagggtcggtaggggacacggcgacgtacgtcggcccggttggttcgggacgggacggaccgaacgcgtacgaacccgtcgtcggacacgacccgacggcctccccgg

SEQ ID NO: 333753 - DNA, 486 bp, Homo sapiens
  misc_feature: GZ8MTXP02IOV87.51.60.F05.1.454.CMB.2.raw
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataatatgctgcctggtatcagcagaagccaggcccagtcccctgtggtggtcatctatcaagacaccaagcggccctcggggatacccctgagcgattctctggctccacctctgggaacacagccactctgaccatcagcggacgcaggctgtgatgaggctgactttacngtcaggcgtgggacngcgacacgtgcgtgtcgggcggagggaccaagctagaaccgtctcggtcagcccaggctcccgg

SEQ ID NO: 333754 - DNA, 582 bp, Homo sapiens
  misc_feature: GZ8MTXP02G1ERO.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaattgcgagataaatatgctgcctggtatcagcagaacgccaggccagtcccctggtggtggtcatctatacaaacgaccaaccgaacgccggcccgtacggggactaccccgtgacgcgattctctcggcctccacctcgtacgggaaccacgacgcccactctacgaccatcgaggcgggacgcgaggctggtggagtggaggtcttagtacttttacgtgtcgagggtcggtagggacgacggacgacgacgtcggccggttgggttccgggcggggaacgggaccgaacggtccgtacggtaacccggttccgtaccgggtaccaccggacccgaacgggtcccgtccccgg

SEQ ID NO: 333755 - DNA, 506 bp, Homo sapiens
  misc_feature: GZ8MTXP02FS2TH.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagccggcctcggggataccccgtgagcgattctctggcctccacctctcggggaacacagccactctgaccatcagcggacgcgaggctgtggatgaggctgtacttttacgtgtcgaggcgtgggacagcgacacgtcgccgtggttcggcggacggaccgaagctacgaaccgtccgtcggtcacgccacggctccccgg

SEQ ID NO: 333756 - DNA, 538 bp, Homo sapiens
  misc_feature: GZ8MTXP02IY42C.51.60.F05.1.454.CMB.2.raw
  modified_base (201)..(201): a, c, t, g, unknown or other
  misc_feature (201)..(201): n is a, c, g, or t
  modified_base (413)..(413): a, c, t, g, unknown or other
  misc_feature (413)..(413): n is a, c, g, or t
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgcgagataaatatgctgcctggtatcagcagaagccaggccagtcccctggtggtggtcatctatcaagacacaagccggccctcggggactacccctgacgcgattctcgtggcctcccacctcgtacggggaaccacgagcccaactctcgaccagtcgaggcgggacgcgaggccgtggnggatggaggcttgtaccttttagngtcgagggcgtgggacngacgacacgtgccgttaggtcgggcggacgggaccaacggcgtacgaacccgtccgtcggtacacgacccgaggccgtccccgg

SEQ ID NO: 333757 - DNA, 639 bp, Homo sapiens
  misc_feature: GZ8MTXP02H528H.51.60.F05.1.454.CMB.2.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaatgacgagaataaatatgctgcctggtatcagcagaagccaggcccagtcccctgtggtggtcatctatcaagacacagcggccncggggataccctgagcgattcnctgctccactctgggaaccncacgcccactctacgacccaatccgaggaccggggaccgcgacgggccgttggtgggaagttcgggaacggtcgtttaggttacctttttaacgtggtaccgtaaggggtccggttgggggaacaggccgaaccgtaccgtcggtacccggggttgggtttccgggggaccgggggaacgggggtaacccaaacggggtccgttaccgggtaaccccggttcccccggtttacgggtacccggaacccggacccccggaaacgggtcccccgtttccccccgggg

SEQ ID NO: 333758 - DNA, 495 bp, Homo sapiens
  misc_feature: GZ8MTXP02IBXZB.51.60.F05.1.454.CMB.2.raw
  modified_base (390)..(390): a, c, t, g, unknown or other
  misc_feature (390)..(390): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (490)..(490): a, c, t, g, unknown or other
  misc_feature (490)..(490): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtctccccaggacaaacagccagcatcacctgctctggagataaatgcgagataaatatgctgcctggtatcagcagaagccaggccagtcccctggtggtggtcatctatcaagacaccaagccgccctggggataccccgtgagcgattctctcggctccactcgtagggaacacagccactctgaccatcagcggacgcaggctgngatgagctgtactttacngtcaggcgtgggacngcgacactcgcgttggtcggcgggacggaccaagctgaaccgtcacgggtcacggccccaaggtccncccgg

SEQ ID NO: 333759 - DNA, 603 bp, Homo sapiens
  misc_feature: GZ8MTXP02HY8UA.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (416)..(416): a, c, t, g, unknown or other
  misc_feature (416)..(416): n is a, c, g, or t
  modified_base (444)..(444): a, c, t, g, unknown or other
  misc_feature (444)..(444): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaattgcganaataaatatgctgcctggtatcagcagagccaggccagtcccctggtggtggtcatctatcaagacaccgaagccggcccgtcggggataccccgtgacgcgtacttctcgtcggcctccaccgtcgtacggggaacacacgcccactctacgaccatcaacggcgggacgcgaggctggngagtggacggtcttagttacttttacgngtcgagggcggtagggacacggcgacgacgtcggtccgggttgggttccggggacggggtaacggggacccgtaaacggcccgtacgggtaacccccggttcccggttacccgggtcccggaaaccggcccccgtaaacggggtcccgttacccccggg

SEQ ID NO: 333760 - DNA, 529 bp, Homo sapiens
  misc_feature: GZ8MTXP02HRJQ7.51.60.F05.1.454.CMB.2.raw
  modified_base (420)..(420): a, c, t, g, unknown or other
  misc_feature (420)..(420): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctggtggtggtcatctatcaagacacaagcgccctcggggataccccgtgagcgattctctggcctccacctctaggggaaccacgagcccaactctcgacccatcagcgggaacgcgaggctgtggatgaggctgactttacngtcgaggcgtgggacagcgacacgtcgccgtggttccggacgggacgggaccaacggccgtcggaacccgtccgtaccgggtaccacggaccccgaaggccctccccgg

SEQ ID NO: 333761 - DNA, 516 bp, Homo sapiens
  misc_feature: GZ8MTXP02IDLWW.51.60.F05.1.454.CMB.2.raw
  modified_base (201)..(201): a, c, t, g, unknown or other
  misc_feature (201)..(201): n is a, c, g, or t
  modified_base (255)..(255): a, c, t, g, unknown or other
  misc_feature (255)..(255): n is a, c, g, or t
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
  modified_base (482)..(482): a, c, t, g, unknown or other
  misc_feature (482)..(482): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgcgagataaatatgctgcctggtancagcagagccagccagtcccctgtggtggtcatctatcaagacacaagccggccctggggataccccgtgagcgattctctggcctccactcgtagggaaccacacgcccacttcacgaccatcgaagcgggacgcacggctggtggagtggaggcttgtacttttacngtccgaggtcggtgggacngcgacacgtcggcggtggtcggacgggacggaccacgcncgaaccgtcgtcggcacgcccgaaggcctcccgg

SEQ ID NO: 333762 - DNA, 510 bp, Homo sapiens
  misc_feature: GZ8MTXP02H245G.51.60.F05.1.454.CMB.2.raw
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaatgcgagataaatatgctgcctggtatcagcagagccagccagtcccctgtggtggtcatctatcaagacaccaagccgcccgtcggggataccccgtgagcgattctcgtcggcctccacctcgtacgggaaccacgacgcccactcncgaccatcgagcgggacgcgaggctgtggatggagctgtactttacgngtcgaggcgtggacagcgacacgtgccgtggtcggcggacggaccgagctcggaaccgtccgtcggccacgcccaacggcctcccgg

SEQ ID NO: 333763 - DNA, 552 bp, Homo sapiens
  misc_feature: GZ8MTXP02I8REL.51.60.F05.1.454.CMB.2.raw
  modified_base (200)..(200): a, c, t, g, unknown or other
  misc_feature (200)..(200): n is a, c, g, or t
  modified_base (438)..(438): a, c, t, g, unknown or other
  misc_feature (438)..(438): n is a, c, g, or t
  modified_base (462)..(462): a, c, t, g, unknown or other
  misc_feature (462)..(462): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagaataaatatgctgcctggtatcagcagaacgccaggccagtcccctgtggtggtcatctatcaagacaccaacgccggcccgtcggggataccccgtgacgcgattctcgtcggcctccacctcgtacgggaaccacacgcccactcctagaccagtcaggccgggacgcgaggctggtggaagtggaggtctgtactttacgngtcgagggcgtgggacaggcgacncgtcggccgttggttacgggcggggaacgggacccaacggtccgacggtaaccgtccgtaccggcgacgcccgtaacggcccttccccgg

SEQ ID NO: 333764 - DNA, 571 bp, Homo sapiens
  misc_feature: GZ8MTXP02G6FH9.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggcccagtcccctgtggtggtcatctatcaagacacaagccggccctcggggataccccgtgacgcgtattctctcggcctccacctcgtacgggaacacacgcccactctcgaccacgtcgaggcgggaccgcgacggcgtggcggatggaggtctgtaccttttacgtcgtcgtagggcggtgggacaggcgacgtacgtcggcccggttgggttccgggacgggaacgggaccgaaacggccgttacgggaaccccgttccggtccggtaccgaccggaccccgtaacgggccctcccccgg

SEQ ID NO: 333765 - DNA, 488 bp, Homo sapiens
  misc_feature: GZ8MTXP02I2PYS.51.60.F05.1.454.CMB.2.raw
  modified_base (384)..(384): a, c, t, g, unknown or other
  misc_feature (384)..(384): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacccctgagcgattctctggcctccacctctgggaacacagcccactctgaccatcagcgggacncgaggctgtggatgaggctgtactttangtcgaggcgtggacngcgacactcgcgtgtcggnggacggacagctcgaaccgtcgcggtcacgccacggctcccg

SEQ ID NO: 333766 - DNA, 511 bp, Homo sapiens
  misc_feature: GZ8MTXP02GQAI5.51.60.F05.1.454.CMB.2.raw
  modified_base (200)..(200): a, c, t, g, unknown or other
  misc_feature (200)..(200): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (489)..(489): a, c, t, g, unknown or other
  misc_feature (489)..(489): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggtatcagcagaagccaggccagtcccctgtggtggtcatctatcaagacaccaaagccggccctcggggataccccgtgagcgattctctcgggctccacctctagggaaccacacgccactctcgaccatcagccgggacgcgaggctgtggatgaggtctgtacttttacgngtcaggcgtgggacngcgacacgtcgcccgtggttccggcggacgggaccaagccgtgaaccgtcncggtcacgcccaacggctcccg

SEQ ID NO: 333767 - DNA, 497 bp, Homo sapiens
  misc_feature: GZ8MTXP02HC97V.51.60.F05.1.454.CMB.2.raw
  modified_base (200)..(200): a, c, t, g, unknown or other
  misc_feature (200)..(200): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (474)..(474): a, c, t, g, unknown or other
  misc_feature (474)..(474): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggtatcagcagagccaggccagtcccctgtggtggtcatctatcaagacacaagcgcctcggggataccccgtgagcgattctctgctccactcgtgggacncagccactctgaccatcagcgggacncgaggctagcgatgaggctgactttactgtcaggngtcggggacnggcgacacgtcggccgtggttccggcgggacggaccgacgctcggaaccgtcncggtcacgcccaacggctcccgg

SEQ ID NO: 333768 - DNA, 633 bp, Homo sapiens
  misc_feature: GZ8MTXP02GEL3T.51.60.F05.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (410)..(410): a, c, t, g, unknown or other
  misc_feature (410)..(410): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggagtccttgcttactgcacaggatttgtggcctcctatgagctgattcagcccaccctcagtcgtccgtgtccccaggacaaacngccagcatcacctgctctgganataattgcgagataaatatgctgcctggtatcagcagaacgccgacggccacgtcccctggtcggtggtcatctatacaagaccaaccgaacggccggcccgtacggggactaccccgtgacgtcgtacttcgtccgtcggccctccaccgtcgtacgggaaccacgacgcccactctacgaccancgaggcggacgcgaggctggtgagtggtacggtcgtttagtaccgttttacggtacggtaacggtcgggtacgggacaacggtccgaaccgtcgtccggtaccggttcgggttaccggggccggggaacgggtacccgaacggtcccgtaccggtaaccccggtccggtacccggtacccgtaccggaccccgtaacgggtccccgtcccggttcccccccgg

SEQ ID NO: 333769 - DNA, 532 bp, Homo sapiens
  misc_feature: GZ8MTXP02JD2RA.51.60.F05.1.454.CMB.2.raw
  modified_base (440)..(440): a, c, t, g, unknown or other
  misc_feature (440)..(440): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagccggcccctggggactaccccgtgacgcgattctctggccttccacctctgggaaccacagccactctgacccatcagcgggacgcgaggctgtgagtgaggctagtactttacgtgtcgagggtcgtgggaacngacgacgtacgtcggccggttggtcgggacgggaacgggaccgacgcgtacgtaacccgtccgtccggtacacggacccgacggtcctcccg

SEQ ID NO: 333770 - DNA, 498 bp, Homo sapiens
  misc_feature: GZ8MTXP02FNYHL.51.60.F05.1.454.CMB.2.raw
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
  modified_base (464)..(464): a, c, t, g, unknown or other
  misc_feature (464)..(464): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaaagacaccaaagccggcctggggatacccctgacncgattcnctggcctccactcgtgggaacacagcccactctgacatcagcgggacgcaggctagngatgaggctgtactttacgngtcaggcgtgggacagcgacactcgccgtgttcgggcggacggaccagcngaaccgtccgtcggtcacgcccgaaggctcccgg

SEQ ID NO: 333771 - DNA, 495 bp, Homo sapiens
  misc_feature: GZ8MTXP02IKOI4.51.60.F05.1.454.CMB.2.raw
  modified_base (275)..(275): a, c, t, g, unknown or other
  misc_feature (275)..(275): n is a, c, g, or t
  modified_base (386)..(386): a, c, t, g, unknown or other
  misc_feature (386)..(386): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataatgcgagataatatgctgcctggtatcagcagaagccaggccagtccccngtggtggtcatctatcaagacaccaagccggcccgtcggggatacccctgagcgattctctggctccacctcgtacgggaaccacacgccactctgaccatcagcgggacncaggctgtggatggaggctgtactttacngtcgaggcgtggacngcgacactgcgtgtcgggcggacggacaagcgtgaaccgtcgtcggtcacgcccaaggctcccgg

SEQ ID NO: 333772 - DNA, 491 bp, Homo sapiens
  misc_feature: GZ8MTXP02IPRHV.51.60.F05.1.454.CMB.2.raw
  modified_base (222)..(222): a, c, t, g, unknown or other
  misc_feature (222)..(222): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (477)..(477): a, c, t, g, unknown or other
  misc_feature (477)..(477): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataatatgctgcctggtatcagcagaagccaggccagtcccctggtggtggtcatctatcaagacacaagcgcccgtcggggactaccctgagcgtattctctcggctccacctcgtggaacacagccactctgaccancagcggacgnaggctgtgatgagtctgtactttacgngtcgaggcgtggacngcgancgtcgcgtcggtcggacggaggaccaaggctcgaaccgtcgtcgtcngcccaggctcccgg

SEQ ID NO: 333773 - DNA, 537 bp, Homo sapiens
  misc_feature: GZ8MTXP02H6MCC.51.60.F05.1.454.CMB.2.raw
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgcgagataaatatgctgcctggtatcagcagaagccaggccagtcccctggtggtggtcatctatcaagacaccaagccggcccgtacggggactacccctgagcgattctctgctccactctgggaacacacgcccactcngacccatccaggccgggacgcgaggctgtggatggagctgtacttttangtcgaggcgtggggacaggcgacgacgtggccggttggttcgggcgggtaacggggaccaacggtcgtacggaacccggtccgtacggtaccgacggaccccgaaggtccctccccgg

SEQ ID NO: 333774 - DNA, 513 bp, Homo sapiens
  misc_feature: GZ8MTXP02FMG58.51.60.F05.1.454.CMB.2.raw
  modified_base (200)..(200): a, c, t, g, unknown or other
  misc_feature (200)..(200): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaagccaggccagtcccctgtggtggtcatctatcaagacaccaagcggccctcggggataccccgtgagcgattctctgggcctccacctcgtacggggaaccacacgcccactctcgaccatcgagcgggacgcgaggctgnggatggagctgtacttttacgngtcgaggcgtgggacagcgacacgtcgccgtggtcggcggacggaccaagcgtgaacccgtcgtcggtcacgacccgaggcctcccgg

SEQ ID NO: 333775 - DNA, 514 bp, Homo sapiens
  misc_feature: GZ8MTXP02HARZJ.51.60.F05.1.454.CMB.2.raw
  modified_base (339)..(339): a, c, t, g, unknown or other
  misc_feature (339)..(339): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
  modified_base (479)..(479): a, c, t, g, unknown or other
  misc_feature (479)..(479): n is a, c, g, or t
  modified_base (511)..(511): a, c, t, g, unknown or other
  misc_feature (511)..(511): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctggtggtggtcatctatcaaagacaccaaagccggcctcggggataccccgtgagcgattcnctcgggctccacctcgtagggaaaccacacgcccactctgaaccancaagcgggacncgaggctgnggatggagctgtatttacngtcaggcgtggacngacgacactgccgtggttcggcgggagggaccctaagccgngaaccgtccgtacggcacgcccaagggtcccnccg

SEQ ID NO: 333776 - DNA, 562 bp, Homo sapiens
  misc_feature: GZ8MTXP02IZZTW.51.60.F05.1.454.CMB.2.raw
  modified_base (381)..(381): a, c, t, g, unknown or other
  misc_feature (381)..(381): n is a, c, g, or t
  modified_base (439)..(439): a, c, t, g, unknown or other
  misc_feature (439)..(439): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaatgcgagataaatatgctgcctggtatcagcagaagccaggccagtcccctgtgtggtcatctatcaagacaccaacggccgccctacggggataccccgtgacgcgtattctcgtggcctccacctcgtgggaacacagcccactctcgaccntacgaggccgggacgccgagggtcctggtgagtggacggtcttaggtaccttttacgngttacgagggtcgtagggactaggaccgacacgtcggccgttgggttccgggacgggaacgggaccgaacggccgtacgaacccggtccgtccggtcgaccgcccgaacggtcccgtccccgg

SEQ ID NO: 333777 - DNA, 605 bp, Homo sapiens
  misc_feature: GZ8MTXP02FY09V.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (344)..(344): a, c, t, g, unknown or other
  misc_feature (344)..(344): n is a, c, g, or t
  modified_base (402)..(402): a, c, t, g, unknown or other
  misc_feature (402)..(402): n is a, c, g, or t
  modified_base (479)..(479): a, c, t, g, unknown or other
  misc_feature (479)..(479): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaattgcgagaataaatatgctgcctggtatcagcagaagccaggccagtcccctggtggtgtcatctatcaagacaccgaaagccggccctcggggactaccccgtgacgcgtacttcncgtcggtcctcccacctcgtacggggaaccacgacgccctacgtcctacgaacctacncgacgggaccggggaccgcgaacggggtcctaggtacggtagtcggaagggtccgttaggttaaccctttttaacgngttaccggacggggtccggttagggggaaaccgacggaccgacgtcggtcggtccggttgggtccggggacggaacggaccgacgcgtaccgaacccgtcgtcgtaccgacgaccgacggcctccg

SEQ ID NO: 333778 - DNA, 507 bp, Homo sapiens
  misc_feature: GZ8MTXP02FWNNO.51.60.F05.1.454.CMB.2.raw
  modified_base (222)..(222): a, c, t, g, unknown or other
  misc_feature (222)..(222): n is a, c, g, or t
  modified_base (334)..(334): a, c, t, g, unknown or other
  misc_feature (334)..(334): n is a, c, g, or t
  modified_base (412)..(412): a, c, t, g, unknown or other
  misc_feature (412)..(412): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggtatcagcagaagccaggccagtcccctgtggtggtcatctatcaagacacaagcggcctcggggactacccctgagcgattcnctggctccactctcgggaacacagccactctcgaccatcagcgggacgcgaggctgtggatggaggctgtactttacngtcgaggcgtgggacagcgacgactcgccggtggtcggcggacgggaccgaagctacggaacccgtcgtcggtccacggcccgaacggctcccgg

SEQ ID NO: 333779 - DNA, 538 bp, Homo sapiens
  misc_feature: GZ8MTXP02H730M.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (335)..(335): a, c, t, g, unknown or other
  misc_feature (335)..(335): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaatgcgagataaatatgctgcctggtatcagcagaagccaggccagtcccctgtggtggtcatctatcaagacacaagccggccctcggggatacccctgagcgattcncttggcctccactctagggaacacagcccactcncgacccatcgaagcgggacncgaggctgtggatggaggctgtactttacgngttccgagggcgtggggaacngacggtacacgtcggccgttggtccgggacgggacgggaccgaacgtcgacggtaaccccgtccgtacggtcgacgccccgaaagggccctccccgg

SEQ ID NO: 333780 - DNA, 754 bp, Homo sapiens
  misc_feature: GZ8MTXP02JBE19.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataatgcgagataatatgctgcctggtatcgagcaggaacgccgaaggcccacgttcccctggtggtcggtcatctatacaacgaccaccgaacgccggccgtacgggactacccgtgacgcgtattctacgtcggcctccaccgtcgtacgggaacctacacgaccctacgtcctacggaccctagtacccgaacgggaccggggaccgacggtacgggtccgttagggttcgggaaaggtacgggtacgggtaccgtttaggttaacccgttttttaacgtcggttacccggagggggtaccggggttacggggaaaccgtaccgggaccgttaaaccggacccgtttccggggtacccgggttttggggtaccccggggggaaccggggaacccgggggttaaacccgaaacggggtcccccggtttaaccggggaaccccccgggtttcccggggttaccccgggtaacccggtaaacccggggaccccccggtttaaaacggggacccccgtttccccccccggggg

SEQ ID NO: 333781 - DNA, 512 bp, Homo sapiens
  misc_feature: GZ8MTXP02GU8RX.51.60.F05.1.454.CMB.2.raw
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaatgcgagataaatatgctgcctggtatcagcagagccagccagtcccctgtggtggtcatctatcaaagcaaccaagcggcctcggggataccccgtgacgcgattcgtcttggcctccacctctcgggaacacagcccactctacgaccatcagcgggacgcgtaggctgtggatgaggctgtactttacngtcgaggcgtgggacngcgacacgtcgccgtggttcggcggacggaccgaagcgtcgaaccgtcctacgggtcacgacccgaacggccgtcccg

SEQ ID NO: 333782 - DNA, 582 bp, Homo sapiens
  misc_feature: GZ8MTXP02IUNB0.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (432)..(432): a, c, t, g, unknown or other
  misc_feature (432)..(432): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaattgcgagataaatatgctgcctggtatcagcagaagccaggcccagtcccctgtggtggtcatctatcaaagaccaccaaaggccggccccgtacggggactacccccgtggacgcgtactttctccgttcgggccttcccaccctcgtacggggaaccacgacgcccactctcgaccaactcaggccgggacgcgagggctggnggatggaggtctagtaccttttagtgtcgaggcgtgggacaggcgacacgtcggcccggttggttccggggacgggacggggaccgaaacggtccgtacggtaacccggtccgtaccgggtaccaccggacccgaacgggccttccccgg

SEQ ID NO: 333783 - DNA, 515 bp, Homo sapiens
  misc_feature: GZ8MTXP02HQSEA.51.60.F05.1.454.CMB.2.raw
  modified_base (352)..(352): a, c, t, g, unknown or other
  misc_feature (352)..(352): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagcgccctcggggataccccgtgagcgattctctgctcactctgggacncagccactctgacatcagcggacgnagctgtgatgagctgacttttacgngtcgaggcggtaggacagcgacgacgtcgccggttggtacggacgggacggaccgaacgtccgtacggaacccgttccggtcggtaccgaccggacccgaacggtcccgtccg

SEQ ID NO: 333784 - DNA, 634 bp, Homo sapiens
  misc_feature: GZ8MTXP02HP3PY.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (454)..(454): a, c, t, g, unknown or other
  misc_feature (454)..(454): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganaataaatgacgaagataaatatgctgcctggtatcagcagaagccaggccagtcccctggtggtggtcatctatcaagacaccaagccggccctacggggataccccgtgacgcgtatttctcgtggcctccacctcgtacggggaaccacgacgcccactctacgaccaatcgaggcgggacgacgacggcgttggtggagttggacggtcgtttaggtactttttacgngttacgacgggcggttacggggacgaggccgtaaacgaccggttcgggtcccggggtttgggttcccgggggacggggtaacgggggtacccgaaacggtcccggtacgggaacccccggttcccgttaccggggtacccgaccggtacccccggaaacggtccccgtttccccccgggg

SEQ ID NO: 333785 - DNA, 491 bp, Homo sapiens
  misc_feature: GZ8MTXP02GI7C0.51.60.F05.1.454.CMB.2.raw
  modified_base (410)..(410): a, c, t, g, unknown or other
  misc_feature (410)..(410): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacccctgagcgattctctggctccacctctgggaacacagccactctgaccatcagcgggacgcaggctagtgatgaggctgtactttacngtcaggcgtgggacagcgacactcgccgtgttcggcggaggaccaagctcgaaccgtccacggtcacgcccaaggctcccg

SEQ ID NO: 333786 - DNA, 567 bp, Homo sapiens
  misc_feature: GZ8MTXP02GUV3H.51.60.F05.1.454.CMB.2.raw
  modified_base (440)..(440): a, c, t, g, unknown or other
  misc_feature (440)..(440): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagaataaatatgctgcctggtatcagcagaagccaggccagtcccctggtggtggtcatctatcaaacgacaccaagccggccctcggggatacccccgtgacgcgtacttcgtcgtggcctcccacctcgtacggggaaccacgacgcccactctcgacccatcagcgggacgcgaggctgtggagtggaggtctgtacttttacgngtaccgaggcggtgggacgagacgacacgtcggccggtggttccgggacggaacggggaccgaaacggtccgtacgaacccggttcccgtccgggtaccgaccgaccccgaacggtcccgtccccgg

SEQ ID NO: 333787 - DNA, 535 bp, Homo sapiens
  misc_feature: GZ8MTXP02F1PCK.51.60.F05.1.454.CMB.2.raw
  modified_base (200)..(200): a, c, t, g, unknown or other
  misc_feature (200)..(200): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggtatcagcagaagccaggccagtcccctgtggtggtcatctatcaagacaccgaaagccggccctcggggactaccccgtgacgcgtattctctggcctccacctcgtacgggaacacgagcccacgtctcgaccatcagcgggcgcgaggctggtgatggaggctggtacttttacgngttccgagggtcggtgggacnggcgacacgtcggccgttggtccgggcgggacgggaccaaggccgtagaacccgtccgcggtacacgcccgaacgggcctccccgg

SEQ ID NO: 333788 - DNA, 497 bp, Homo sapiens
  misc_feature: GZ8MTXP02JX7EA.51.60.F05.1.454.CMB.2.raw
  modified_base (339)..(339): a, c, t, g, unknown or other
  misc_feature (339)..(339): n is a, c, g, or t
  modified_base (467)..(467): a, c, t, g, unknown or other
  misc_feature (467)..(467): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtcccgtgtccccaggacaaacagccagcatcacctgctctggagataaattgcgagataaatatgctgccctggtatcagcagaagccaggccagtccccctgtggtggtcatctatcaagacaccaagccggccctcggggatacccctgagcgattcnctggctccacctctggaacacagcccactctgaccatcagcgggacgcaggctgtggatggaggctgtactttactgtcaggcgtgggacagcgacacgtcgccgtgtcgggcggtacgggaccagcncgaaccgtctcggcacgccgagccgtcccg

SEQ ID NO: 333789 - DNA, 515 bp, Homo sapiens
  misc_feature: GZ8MTXP02GJBUS.51.60.F05.1.454.CMB.2.raw
  modified_base (416)..(416): a, c, t, g, unknown or other
  misc_feature (416)..(416): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccagccagtcccctgtggtggtcatctatcaagacaccaagccggccctcggggatacccctgagcgattctctgggcctccacctcgtgggaacacagcccactctcgaccatcagcgggacgcaggctgtggatgaggctgtacttttacngtcgaggcggtgggacagcgacacgtcgccggtggttcgggcgggacgggaccgaacgcgtcgaaccgtccgtcggtccacggcccaacggctccccgg

SEQ ID NO: 333790 - DNA, 577 bp, Homo sapiens
  misc_feature: GZ8MTXP02JO0QP.51.60.F05.1.454.CMB.2.raw
  modified_base (200)..(200): a, c, t, g, unknown or other
  misc_feature (200)..(200): n is a, c, g, or t
  modified_base (346)..(346): a, c, t, g, unknown or other
  misc_feature (346)..(346): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggtatcagcagaagccaggccacgtcccctgtcggtggtcatctatcaagacaccaagtccggcccgtacggggactaccccgtgacgtcgtacttcncgtggcctccacctcgtacgggaaccacacgcccactctacgaccatcgaggcgggacgcgacggctggtggatgggaggtccgttgttacctttttacgtgtacgacgggcggtcggggacacggacgacgtacgtcggtccggttcgggtccggacggggaacgggaccgaacggtcgtacggaacccggtcccgtacgggaccgacgacccgaacggccgtcccccgg

SEQ ID NO: 333791 - DNA, 500 bp, Homo sapiens
  misc_feature: GZ8MTXP02IS3QM.51.60.F05.1.454.CMB.2.raw
  modified_base (396)..(396): a, c, t, g, unknown or other
  misc_feature (396)..(396): n is a, c, g, or t
  modified_base (431)..(431): a, c, t, g, unknown or other
  misc_feature (431)..(431): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataatatgctgcctggtatcagcagaagcaggccagtcccctgtggtggtcatctatcaagacaccaagccggccctcggggataccccgtgagcgattctcgtcggcctccacctcgtgggaacacacgccactctcgaccatcagcgggacgcaggctgngatgaggctgtactttacgtgtcaggcgtgggacngcgacactcgccgtgtcgggcggacgggaccaagctgaaccgtccgtcggtcacgcccacggctcccgg

SEQ ID NO: 333792 - DNA, 504 bp, Homo sapiens
  misc_feature: GZ8MTXP02GQKVK.51.60.F05.1.454.CMB.2.raw
  modified_base (334)..(334): a, c, t, g, unknown or other
  misc_feature (334)..(334): n is a, c, g, or t
  modified_base (396)..(396): a, c, t, g, unknown or other
  misc_feature (396)..(396): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
  modified_base (488)..(488): a, c, t, g, unknown or other
  misc_feature (488)..(488): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacacaagcgcccgtcggggatacccctgagcgattcncttggcctccactcgtagggaacacagcccactctgacccatcagcgggacgcgacggctgngagtgacggtctagtacttttacngtcgaggcgtgggacngcgacacgtcgcgtgtcggcgggtacggacctaagctgaaccgtccgcgtcncgaccaggcctcccgg

SEQ ID NO: 333793 - DNA, 508 bp, Homo sapiens
  misc_feature: GZ8MTXP02HE0XF.51.60.F05.1.454.CMB.2.raw
  modified_base (223)..(223): a, c, t, g, unknown or other
  misc_feature (223)..(223): n is a, c, g, or t
  modified_base (439)..(439): a, c, t, g, unknown or other
  misc_feature (439)..(439): n is a, c, g, or t
  modified_base (470)..(470): a, c, t, g, unknown or other
  misc_feature (470)..(470): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtcccccaggacaaacagccagcatcacctactctgganataaattgcgagataaatatgctgcctggtatcagcagaagccaggccagtcccctgtggtggtcatctatcaagacaccaagcgccctcggggatacctgagcgattctctggctccacctctgggacacagccaactctgacccatcagccgggacgcgaggctgtggatggagctggtactttacgtgttcagggtcgtgggacagcggaacncgtcgcgtcgtcgggcggagggacccgagcnggacccgtcgtcggacacgccgaacggcctcgcccccg

SEQ ID NO: 333794 - DNA, 502 bp, Homo sapiens
  misc_feature: GZ8MTXP02I264B.51.60.F05.1.454.CMB.2.raw
  modified_base (200)..(200): a, c, t, g, unknown or other
  misc_feature (200)..(200): n is a, c, g, or t
  modified_base (275)..(275): a, c, t, g, unknown or other
  misc_feature (275)..(275): n is a, c, g, or t
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataatgcgagataatatgctgcctggtatcagcagaagccaggccagtccccngtggtggtcatctatcaagacacaagcggccctcggggactaccccgtgagcgattctctggctccacctcgtgggaacacagccacnctgaccatcagcggacgcaggctgtgatgaggctgtactttangtcaggcgtgggacngcgacacgtcgccgtggttcgggcggacggggaccaacgcgtacggaaccgtccgtacggtcacgcccgaacggctcccgg

SEQ ID NO: 333795 - DNA, 549 bp, Homo sapiens
  misc_feature: GZ8MTXP02FZENQ.51.60.F05.1.454.CMB.2.raw
  modified_base (222)..(222): a, c, t, g, unknown or other
  misc_feature (222)..(222): n is a, c, g, or t
  modified_base (335)..(335): a, c, t, g, unknown or other
  misc_feature (335)..(335): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggatcagcagaagccaggccagtcccctgtggtggtcatctatcaagacacaagccggcctcggggataccccgtgacgcgattcnctggcctccacctcgtacggggaaccacgacgcccacgtctgaccatcacgcgggacgcaggctgtggagtgaggctgtactttacgtgtcgaggtcgtgggacgagtcgacacgtcggccggttggttcgggcggtaacggggaccgtaacggccgttacggaacccggttcccggtacggtaccgacggcccgaaacgggtccgtaccccgg

SEQ ID NO: 333796 - DNA, 535 bp, Homo sapiens
  misc_feature: GZ8MTXP02HQA1Q.51.60.F05.1.454.CMB.2.raw
  modified_base (337)..(337): a, c, t, g, unknown or other
  misc_feature (337)..(337): n is a, c, g, or t
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
tcagcgatcgtatacacgaccggtgctcgatttagtacgtcatcagggaaaggggcgtgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctcgtggagataaattggcgagataaatatgactgcctggtatcgagcagtaagccgaggccaggtcccctagtcggtggtcatctatacaagacacgaagccgacctggggactaccccgngacgcgaattcgcgttggcctccactcgtacgggaaacacgacgcccaactcacgaccatcagtcggacgnacggctgtcgatgaggtctagtactttacgngtcgaggtcgtggacaggcgacgtacgcgacccgttggtcggacggacgggaccaagcgtcgaaccgtcgcggtacacgtcccgacgtcctcccgg

SEQ ID NO: 333797 - DNA, 599 bp, Homo sapiens
  misc_feature: GZ8MTXP02GO2CD.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (467)..(467): a, c, t, g, unknown or other
  misc_feature (467)..(467): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgcgagataaatatgctgcctggtatcagcagaacgccaggccagtcccctggtggtggtcatctatacaagacaccgaacggccggcccgtcggggactaccccgtgacgtcgacttcgtacgtcggcctcccacctcgtacgggaaccacgacgcccacgtctacgaccagtacgaggcgggacgcgaggctgtgatggaggtctgtacttttacgcgtacgagggcggtagggaacnggaccgaacgtccgtcgggcccggttcgggttccggggaccggggaacgggacccgaacggtccgtaccgggtaacccggttcccggttaccggtaccgtaccggaccccgaacggggtcccttcccccggg

SEQ ID NO: 333798 - DNA, 485 bp, Homo sapiens
  misc_feature: GZ8MTXP02JSEBN.51.60.F05.1.454.CMB.2.raw
  modified_base (200)..(200): a, c, t, g, unknown or other
  misc_feature (200)..(200): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (421)..(421): a, c, t, g, unknown or other
  misc_feature (421)..(421): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggtatcagcagaagccaggccagtcccctgtggtggtcatctatcaagacaccaagcggccctcggggatacccctgancgattcnctgctccactctgggaacacagcccactctgaccatcagcggacgcaggctgtgatgaggctgtactttactgtcgaggcgtggacngcgacacgtgccgtggtcggcggacggaccgagcgtcgaacgtcctcggcacgcccgagctccg

SEQ ID NO: 333799 - DNA, 504 bp, Homo sapiens
  misc_feature: GZ8MTXP02HZA31.51.60.F05.1.454.CMB.2.raw
  modified_base (200)..(200): a, c, t, g, unknown or other
  misc_feature (200)..(200): n is a, c, g, or t
  modified_base (358)..(358): a, c, t, g, unknown or other
  misc_feature (358)..(358): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaacngccagcatcacctgctctggagataaattgcgagataaatatgctgcctggtatcagcagaagccaggccagtcccctgtggtggtcatctatcagacacaagcgccctggggactcccgtgagcgattctctggcctccaccctcgtcgggaaaccncacgcccaactctacgacccatcagcgggaccngaggctgngatggaggntgtactttangtgaggcgtgggacnggcgacncgtcgccgtggtcggcggacggaccgagcgtgaacccgtcgtcggtcagcccgaggcctcccgg

SEQ ID NO: 333800 - DNA, 539 bp, Homo sapiens
  misc_feature: GZ8MTXP02I9C6V.51.60.F05.1.454.CMB.2.raw
  modified_base (199)..(199): a, c, t, g, unknown or other
  misc_feature (199)..(199): n is a, c, g, or t
  modified_base (276)..(276): a, c, t, g, unknown or other
  misc_feature (276)..(276): n is a, c, g, or t
  modified_base (331)..(331): a, c, t, g, unknown or other
  misc_feature (331)..(331): n is a, c, g, or t
  modified_base (384)..(384): a, c, t, g, unknown or other
  misc_feature (384)..(384): n is a, c, g, or t
  modified_base (412)..(412): a, c, t, g, unknown or other
  misc_feature (412)..(412): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctggagataaattgcgagataaatatgctgcctggtatcagcagaagccagccagtccccngtggtgtcatctatcaagacaccaagcgccctggggatacccctgagcgattctntggcctccacctcgtagggaaccacacgcccactctcgaccatcagcgggacncgagctgtggatggagctgtactttagngtcgaggtcggtggacgagcgacgacgtcgccggttggttccgggacggaacggggaccccgaaaggtccgtacggaacccgttcccgtcggggtccaacggccccgtaaagggcccttcccccggg

SEQ ID NO: 333801 - DNA, 634 bp, Homo sapiens
  misc_feature: GZ8MTXP02JZ6I1.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgacgagataaatatgctgcctggtatcagcagaagccaggccagtcccctgtggtggcatctatcaagaccaccaaggccggccccgtcggggactacccccgtggacgcggtacttctcgtcgggcctcccaccttccgtaggggaaaccacgaacgccctaacccttcgtacgaccctactccgaacggccggggaccggccgaacgggtccgtggtagggagtggaacgggtctaggttactttacgtgtcgacggggtcggtacgggacgacggtaccgacgtaccggttcgacccgggttcggttaccgggggacggggaaccggggaccgaaacggtcccggttacggaacccggttcccgtccggtaccaccggaccccgaacggtccgtccccccgg

SEQ ID NO: 333802 - DNA, 502 bp, Homo sapiens
  misc_feature: GZ8MTXP02JYQCL.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
  modified_base (318)..(318): a, c, t, g, unknown or other
  misc_feature (318)..(318): n is a, c, g, or t
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtcctttgcttactgcacaggatttgtggcctcctatgagctgattcagccaccctcagtgtccgtgtccccaggacaaacngccagcatcacctgctctgganataaattgcgagataaatatgctgcctggtatcagcagaagccaggccagtcccctgtggtggcanctatcaagacaccaagcggccctcggggntacccctgagcgatttcnctggctcccacctcgtgggaacncacgcccactctcgaccatcagcgggacgcagggctggtggatggaggctgtactttacgtgtcaggcgtggacgagcganacgtcgcgtgttcggcgggacggaccagcngaaccgtcgtcgtcacgcccgaagcctcccgg

SEQ ID NO: 333803 - DNA, 702 bp, Homo sapiens
  misc_feature: GZ8MTXP02IB9OQ.51.60.F05.1.454.CMB.2.raw
  modified_base (172)..(172): a, c, t, g, unknown or other
  misc_feature (172)..(172): n is a, c, g, or t
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
tcagcgatcgtatacacgaccggtgctcgatttagtacgtcatcagggaaagggctgggcctcaggaagcagcatcggagtgcctcagccatggcatggatccctctcttcctcggcgtccttgcttactgcacaggatttgtggcctcctatgagctgattcagccacctnagtgtccgtgtccccaggacaacngccagcatcacctgctctgganataatgcgagataatntgctgccctggtactcgagctaagacgtccgaaggccctaagtccccctaggtcggtcggtcctaagtccgtaagtccaaaggtaccaaccgtaaagcccggtacctacgggggattacccccgtagtacgtccgtatttccgtacgttcgggccctttacgacccgttccgtaggggtaaaccctacgtaacgtcccgtaccttcgtacgacccgtagtaccgacggtcggtaaccgtcgtaaggtcccgttagtacggtacttcggtacggtcttacggtacttttaccggagttaccgtacggtccgttagggtacctaacggtccgtaaacgtaaccgtcggttacccggttaggtaccgggtacggtaaccgggtaacctaaacgggttcgttaccggaacccggttaccgtaccggtaccgtaaccgtccccggtaaaacggttcccgtttaacccccgggg

SEQ ID NO: 333804 - DNA, 518 bp, Homo sapiens
  misc_feature: GZ8MTXP02IYOF7.51.60.F05.1.454.CMB.2.raw
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacacaagcgcctggggactaccctgagcgattctctggcctccacctcgtagggaacacacgcccactctcgaccatcagcggacncgaggctgngagtgacgcttgacttttacgngtcgaggcgtgggacaggcgacacgtcgccgttggttcggacgggacgggtaccaacggctacggaacccgtccgcggtccgacgcccgaacggtcctccccgg

SEQ ID NO: 333805 - DNA, 534 bp, Homo sapiens
  misc_feature: GZ8MTXP02HU0BE.51.60.F05.1.454.CMB.2.raw
  modified_base (200)..(200): a, c, t, g, unknown or other
  misc_feature (200)..(200): n is a, c, g, or t
  modified_base (404)..(404): a, c, t, g, unknown or other
  misc_feature (404)..(404): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaacgccaggccagtcccctggtggtggtcatctatcaagacacaagccgcccgtcggggactacccgtgacgcgtattctcgtggcctccacctcgtacgggaaccacacgcccactctcgacatcgagcgggacgcaggctgnggagtggaggtcttagtacttttacgcgttcgagggtcggtagggacaggcgacgacgtcggccgttggtcggacgggacggaccgagcgtgaacccgtcgtacggtcacgtcccgaacggtcctcccgg

SEQ ID NO: 333806 - DNA, 500 bp, Homo sapiens
  misc_feature: GZ8MTXP02FGYE4.51.60.F05.1.454.CMB.2.raw
  modified_base (382)..(382): a, c, t, g, unknown or other
  misc_feature (382)..(382): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccagccagtcccctgtggtggtcatctatcaagacaccaagcggcctcggggactaccccgtgagcgattctctggcctccactctgggaacacagccactctgaccatcagcgggacncgaggctgtggatggaggctgtacttttactgtcgaggcgtgggcagcgacactgccgtggttcggcggacggaccgaagcgtagaaccgtccgtcggtcacgcccgaggcctcccgg

SEQ ID NO: 333807 - DNA, 591 bp, Homo sapiens
  misc_feature: GZ8MTXP02I515O.51.60.F05.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcacctgctctgganataatgcgagataatatgctgcctggtatcagcagaagccaggccagtcccctggtcggtggtcatctatcaaacgaccaccaaacggccggcccgtacgggggactacccccgtggacgcgtaagtttcctcgtcgggtcctcccaccgtcgtacggggaaccacgacgtcccactctacgaccctatcgacggcgggaccgcgacggggctggtcggagtggaggtcttgtacctttttgacgtcgtacgggcggtacgggacaggaccgacgtacgtcggtccgtgggttccgggacgggaacgggaccaacggccgttacggaacccgttcgtccggtacgacgcccgaaggcccgtccccgg

SEQ ID NO: 333808 - DNA, 516 bp, Homo sapiens
  misc_feature: GZ8MTXP02IQMMR.51.60.F05.1.454.CMB.2.raw
  modified_base (323)..(323): a, c, t, g, unknown or other
  misc_feature (323)..(323): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgcgagataaatatgctgcctggtatcagcagaagccaggcccagtcccctggtggtggtcatctatcaagcacaagcgccctggggatacccngagcgattctctggcctccacctcgtaggggaaccacagcccactctacgaccatcaggcgggacgcaggctgnggatggaggcttgtacttttacngtcgaggcgtgggacaggcgacacgtcgccgttggtcgggacggacggaccgaacgcgtacgaaccgtcgtcggtacacgcccgaacgccgtcccg

SEQ ID NO: 333809 - DNA, 582 bp, Homo sapiens
  misc_feature: GZ8MTXP02H4S6C.51.60.F05.1.454.CMB.2.raw
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
  modified_base (412)..(412): a, c, t, g, unknown or other
  misc_feature (412)..(412): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggattgtggcctcctatgagctgattcagccaccctcagtgtccgtcgtccccaggacaaacagccagcatcacctactctggagataaattgacgaagaataaatatgctgcctggtatcagcagaagccaggccacgtccctggtggtgtcatctatacaagacaaccgaagcggccccgtaggggactaccgngagcgattctcnggccnccactcgacggaacacacgccactcgtacactancgagcggagcgagctggtggatacgggngtacgttagtttacgttacgtcggtagtagggtacggtacgggacgacggaccgtacgtcgtcggtccgggtcgggtacggggacggaacggaccgtacggccgtaccggtaccccgtaaccggtaccggaccgacccgacccggtaccgtcccgtccccggtacccccg

SEQ ID NO: 333810 - DNA, 692 bp, Homo sapiens
  misc_feature: GZ8MTXP02I43KL.51.60.F05.1.454.CMB.2.raw
  modified_base (200)..(200): a, c, t, g, unknown or other
  misc_feature (200)..(200): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataattgcgagataaatatgctgcctggtatcagcagaagccaggccagtcccctgtcggtggtcatctatcaagcacagcgcctggggactacccctgacgcgattctcgttcgggcctcccacctcgtaggggaacctacgacggtcccacgtcgtacgaccctataccgacgtccggggaaccgtcgtaacgggtcccgttaggtacgggtacgttacgggtaacgggtaccgtttacggttaacccgtttttacgtacggttaccggtaaacggggtccgggtttacgggggaaccgttacgggaccggtaaccggtaaccgttcgggtaccccgggtttcgggttacccgggggtaccggggtaaccggggtacccgtaaaacgggtccgttacgggtaaccccggttcccggtacgggttaccgaaccggtaccccggtaaacgggtcccgtttacccccgggg

SEQ ID NO: 333811 - DNA, 670 bp, Homo sapiens
  misc_feature: GZ8MTXP02HZHUQ.51.60.F05.1.454.CMB.2.raw
  modified_base (202)..(202): a, c, t, g, unknown or other
  misc_feature (202)..(202): n is a, c, g, or t
  modified_base (402)..(402): a, c, t, g, unknown or other
  misc_feature (402)..(402): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcactgctctggagataaatgacgaagataaatatgctgcctggtatcagcagaagccaggccagtcccctgtggtggtcatctatacaagacaaccgaaggccggaccccgtacggggactaccccgtgacgtcgaactttctcgtgggccttccgaaccttcgtacggggaaaccacgacgacccacttcncgaacccatcaacgggcgggaaccgcaacgggctagggtggaaagttgggaaggtccgtttagggttaaccctttttagtacggttcgacggggtccgggttagggggacctacgggacgaaaccgtacggttccggtaccgggtttacgggttccggggaccgggggaaccggggtaaccgaaacgggtcccgttccggaacccccggtttcccgtaccgggttaccgaacccggacccccggaaacggggttccccgtcccccggg

SEQ ID NO: 333812 - DNA, 503 bp, Homo sapiens
  misc_feature: GZ8MTXP02H9XUA.51.60.F05.1.454.CMB.2.raw
  modified_base (175)..(175): a, c, t, g, unknown or other
  misc_feature (175)..(175): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctnagtgtccgtgtccccaggacaaacagccagcatcacctgctctggagataaatgcgagataaatatgctgcctggtatcagcagaagccaggcccagtcccctgtggtggtcatctatcaagacacaagccggcctcggggatacccctgacgcgattcnctggcctccactcgtagggaacncagcccacgtctgaccatcagcgggacgcgaggctgngagtgaggctgtactttangtcaggcgtgggacagcgacacgtgcccgtggttcggcgggacggacccagtcgcgaaccgtcgcggtcacgcccgaaggtcctcccgg

SEQ ID NO: 333813 - DNA, 505 bp, Homo sapiens
  misc_feature: GZ8MTXP02GJFPQ.51.60.F05.1.454.CMB.2.raw
  modified_base (411)..(411): a, c, t, g, unknown or other
  misc_feature (411)..(411): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacccctgagcgattctctggctccactctgggaacacagcccactctgaccatcagcgggacgcaggctgtggatgaggctgacttttacgngtcgaggcgtgggacaggcgacacgtcgccgtggttcggcggacgggaccaaggctcgaaccgtcctacggtccacgcccgaacggcctcccgg

SEQ ID NO: 333814 - DNA, 546 bp, Homo sapiens
  misc_feature: GZ8MTXP02IMZ3X.51.60.F05.1.454.CMB.2.raw
  modified_base (374)..(374): a, c, t, g, unknown or other
  misc_feature (374)..(374): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgcgagataaatatgctgcctggtatcagcagaacgccaggccacgtcccctggtggtgtcatctatcaagacaccaaggccggacccgtcggggactaccccgtgacgcgtattcgtcgtcggcctccacctcgtagggaaccncacgcccactctacgaccatcgagcggggacgcgaggcgtggtggagtggaggtcttacgttacttttacgcgtcgaggcggtagggacgaggcgaacgcgtcggccgttggtccggacggacgggaccaacgctcggaaccgtcgtcggcacgcccgaacggtcctcccgg

SEQ ID NO: 333815 - DNA, 542 bp, Homo sapiens
  misc_feature: GZ8MTXP02I3TEP.51.60.F05.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcacctgctctgganataatgcgagataatatgctgctggtatcagcagaacgccaggcccagtcccctggtggtggtcatctatcaaacgaccaaccaacggccggccccgtacgggggactaccccgtgacgtcgatttctcgtggcctccacctcgtacgggaaccacgacgccctactcctagacccatcgaggcgggaccgcgaggcgtggtggatggaggcttagtacttttacgngtcgaggcgtgggacngcgacncgtcgcggtggtcggacggacggaccaagctacgaaccgtccgtcggtcacgtccgacggtctccccgg

SEQ ID NO: 333816 - DNA, 486 bp, Homo sapiens
  misc_feature: GZ8MTXP02IBUOM.51.60.F05.1.454.CMB.2.raw
  modified_base (369)..(369): a, c, t, g, unknown or other
  misc_feature (369)..(369): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtgtccgtgtccccaggacaaacagccagcatcacctgctctggagataaatgcgagataaatatgctgcctggtatcagcagagccaggccagtcccctgtggtggtcatctatcaagacaccaagcggccctcggggatacccgtgagcgattctctcggctccacctcgtacgggaacacagcccactcngaccatcagcgggacgcaggctgtgatgaggntgtactttangtcgaggcgtggacagcgacacgtgccgttggtcgcggacggacagcngaaccgtcncggtcacgccagctcccg

SEQ ID NO: 333817 - DNA, 652 bp, Homo sapiens
  misc_feature: GZ8MTXP02HZSWR.51.60.F05.1.454.CMB.2.raw
  modified_base (452)..(452): a, c, t, g, unknown or other
  misc_feature (452)..(452): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgacgagataaatatgctgcctggtatcagcagaagccaggcccagtcccctgtggtggtcatctatcaagacacaagccggccctcggggactaccccgtgagcgattctctggcctccacctcgtacgggaaccacgacgcccaactcctagacccatccgacggccggggaccgccgagggcctggtgggaattggacggcgttacgtactttttaccgnggttacgaacgggggtcggtcggggaaccgaggacccggaacgtaacccgtcgggtaacccccggtttggggttacccgggaccgggggaaacggggaacccgaaaacgggcccggttaccggaacccccggttcccgtaacccggggttcccgaaacccggtccccccggaaaacgggggtcccctttcccccccgggg

SEQ ID NO: 333818 - DNA, 511 bp, Homo sapiens
  misc_feature: GZ8MTXP02G4C2V.51.60.F05.1.454.CMB.2.raw
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacccctgagcgattctctggctccacctctgggacacagccactctgaccatcagcggacgcaggctgtggatggaggctgtacttttacgngttccgaggtcgtgggacnggcgacacgtgcccggtgttcgggcggacgggaccaagctcggaaccgtcccgtacggtcgacgcccgaacggcctcccgg

SEQ ID NO: 333819 - DNA, 525 bp, Homo sapiens
  misc_feature: GZ8MTXP02JIROT.51.60.F05.1.454.CMB.2.raw
  modified_base (199)..(199): a, c, t, g, unknown or other
  misc_feature (199)..(199): n is a, c, g, or t
  modified_base (426)..(426): a, c, t, g, unknown or other
  misc_feature (426)..(426): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacngccagcatcacctgctctggagataaattgcgagataaatatgctgcctggtatcagcagaagccaggcccagtcccctgtggtggtcagtctatcaagacaccaagccgccgtcggggactaccccgtgagcgattctctggcctccacctcgtacggggaacacgacgcccactctagacccatcacgcggacgcgaggctgtggatggagcgtgtacttttacngttcgagggcgtgggacaggacgacacgttcgccggtggttcgggcggacgggaccaaggcgtacgaacccgtcgtcggtcacgcccaacggctcccgg

SEQ ID NO: 333820 - DNA, 609 bp, Homo sapiens
  misc_feature: GZ8MTXP02I21ZS.51.60.F05.1.454.CMB.2.raw
  modified_base (200)..(200): a, c, t, g, unknown or other
  misc_feature (200)..(200): n is a, c, g, or t
  modified_base (395)..(395): a, c, t, g, unknown or other
  misc_feature (395)..(395): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataaatatgctgcctggtatcagcaagacgccgaggccacgtcccctggtggtcggtcagtctatacaacgaccaaccgaacggccggcccgtacggggactaccccgtagacgcgtattctcgtcgcctcccaccgtcgtacggaaccacgacgccactcncgaccatcgagcgggacgcgacggctggtgagtaggacggtcgttagttaccttttacgtagtcgacgggtcggtacggggacgacggacgtacgaccggttcggtaccgggttcgggttaccggggacggggaaacggggacccgaacggtccgtaccggtaaccccggttcccgttcggaccgaccggaccccgaacgggcccttcccccgg

SEQ ID NO: 333821 - DNA, 530 bp, Homo sapiens
  misc_feature: GZ8MTXP02IYNFG.51.60.F05.1.454.CMB.2.raw
  modified_base (199)..(199): a, c, t, g, unknown or other
  misc_feature (199)..(199): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgacgagataaatatgctgcctggtatcagcagaagccaggccacgtcccctggtggtggtcatctatacaagacaccaaagccggccgtcggggactaccccgtgacgcgtattctcgtcggcctccacctcgtacgggaacacacgccacttcacgaccataccgagcgggaacgcgaggctaggtggatcggagtctgtacttttacgngtacgaggcggtaggacngcgacncgtcgcggtggtcgggacggacgaccgacgctcgaaccgtcgtccgtacgacgcccgacgcgtcccg

SEQ ID NO: 333822 - DNA, 552 bp, Homo sapiens
  misc_feature: GZ8MTXP02GQPDV.51.60.F05.1.454.CMB.2.raw
  modified_base (200)..(200): a, c, t, g, unknown or other
  misc_feature (200)..(200): n is a, c, g, or t
  modified_base (336)..(336): a, c, t, g, unknown or other
  misc_feature (336)..(336): n is a, c, g, or t
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgagataatatgctgcctggtatcagcagaagccaggccagtcccctggtggtggtcatctatcaagacaccaagccggccctcggggataccccgtgagcgattcnctgggcctcccacctcgtacggggaaccacgacgcccactctcgaccatcgagcgggacgcaggctgtggatggaggctgtacttttacgngtcgagggcggtgggacnggcgacgacgtcgaccggtggttccggggacgggacgggacccgaaggcccgtacggaaccccggttccgtaccggtacgaccgacccgtaacggccgttcccccgg

SEQ ID NO: 333823 - DNA, 588 bp, Homo sapiens
  misc_feature: GZ8MTXP02HEY87.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataatgcgagataaatatgctgcctggtatcagcagaacgccaggccacgtccccgtggtcggtgtcatctatcaaacgaccaaccgaacgccggcccgtacggggtactaccccgtgacgcgtacttctcgttcggcctcccaccgtcgtacgggaacctacgacgcccaactctacgaccataccgacggacgggaccgcgacggtcgtggtggacgtgggagtcgttagttactttacgtcgtacgagggtcgtaggggacaggccgacgcgtcggcggttcggtcggggacggacgggaccaacggccgtacggaacccgttccggtaccggtaccgacggacccgaacggcccgtccccgg

SEQ ID NO: 333824 - DNA, 592 bp, Homo sapiens
  misc_feature: GZ8MTXP02IAFX0.51.60.F05.1.454.CMB.2.raw
  modified_base (176)..(176): a, c, t, g, unknown or other
  misc_feature (176)..(176): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (366)..(366): a, c, t, g, unknown or other
  misc_feature (366)..(366): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctnagtgtccgtgtccccaggacaaacngccagcatcacctgctctggagataaatgcgagataaatangctgcctggtatcagcagaagccaggccagtcccctggtggtggtcatctatcaagacaccgaagccggcccgtcggggataccccgtgacgcgattctctcggctcccactcgtacgggaacncgagcccacctcacgaccatcgacgcgggacgcgaggccgtggtggaagtggaacgggtcttacggttacgtttttacgcgttaccgagggtcggtggggaacgaggaccgaccgtaaccgtcggcccggtttgggtaccgggaccggggaacggggaccgaacggtccgtacgggaaccccgtccgtaccgggtccacccggccccgaacgggtccctcccccgg

SEQ ID NO: 333825 - DNA, 533 bp, Homo sapiens
  misc_feature: GZ8MTXP02HRMC0.51.60.F05.1.454.CMB.2.raw
  modified_base (243)..(243): a, c, t, g, unknown or other
  misc_feature (243)..(243): n is a, c, g, or t
  modified_base (340)..(340): a, c, t, g, unknown or other
  misc_feature (340)..(340): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctggagataaattgcgagataaatangctgctggtatcagcagagccgaggccacgtcccctggtcggtggtcatctatacaagaacaccgaaaggccggtaccccgtggggaactaccccgngacgcgtattctcgtggcctccactcgtggaaacacgaacgcccactctacgacccagacaggcgggacgcgtagggctgggngngngagngtgtacttacgtcgtgacggtggtcggacgacgacgacgcgtcgtcgtcggtcggacggacggacgacgcgcgtccgtcgtcgacgacgaccgacgccgccg

SEQ ID NO: 333826 - DNA, 517 bp, Homo sapiens
  misc_feature: GZ8MTXP02JGY5S.51.60.F05.1.454.CMB.2.raw
  modified_base (200)..(200): a, c, t, g, unknown or other
  misc_feature (200)..(200): n is a, c, g, or t
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagagccagccagtcccctgtggtggtcatctatcaagacaccaagccgcctcggggatacccctgagcgattcgtctgggcctccacctctagggacacgacgccactctgaccaatcagcggacncgaggctgtggatggaggctgtacttttacgngtcgaggtcgtgggacaggcgacnctcggccgtggtcggacgggacggaccaacgcgtacgaacccgtcgtccggtcgacgaccccgaagggcctccccgg

SEQ ID NO: 333827 - DNA, 531 bp, Homo sapiens
  misc_feature: GZ8MTXP02HN2Q0.51.60.F05.1.454.CMB.2.raw
  modified_base (223)..(223): a, c, t, g, unknown or other
  misc_feature (223)..(223): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctgganataaattgcgagataaatatgctgcctggtatcagcagagccaggccagtcccctgtggtggtcatctatcaagacaccaagtcggcccgtcggggactaccccgtgagcgattctcgtggcctccactcgtcgggaacacagcccactctgaccatcaggcgggacgcgaggctgnggagtgaggctgtactttangtcgaggcggtgggacaggcgacacgtcgccggtggttccgggcgggacgggaccgacggtcgtcggaacccgtccgtacggtccgacggtccccgaacggtccgtcccgg

SEQ ID NO: 333828 - DNA, 554 bp, Homo sapiens
  misc_feature: GZ8MTXP02I28GQ.51.60.F05.1.454.CMB.2.raw
  modified_base (222)..(222): a, c, t, g, unknown or other
  misc_feature (222)..(222): n is a, c, g, or t
  modified_base (332)..(332): a, c, t, g, unknown or other
  misc_feature (332)..(332): n is a, c, g, or t
  modified_base (425)..(425): a, c, t, g, unknown or other
  misc_feature (425)..(425): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataatgcgagataatatgctgcctggtatcagcagaagccaggccagtcccctggtggtggtcatctatcaagacaccaagcgccgtggggatccccgtgagcgtattcnctcggctccacctcgtagggaaccacgacgcccactctacgacccatcgagcgggaccgcgaggctgtggatggacggcttgtacttttacgngtaccgagggtcggtggggaacacggacgacgacgtcggcccggttgggttccgggacggggacgggaccgaacggcgtacggaacccgtcccggtcggtaccacggccccgaagggtccctccccggg

SEQ ID NO: 333829 - DNA, 542 bp, Homo sapiens
  misc_feature: GZ8MTXP02FUA1P.51.60.F05.1.454.CMB.2.raw
  modified_base (200)..(200): a, c, t, g, unknown or other
  misc_feature (200)..(200): n is a, c, g, or t
  modified_base (400)..(400): a, c, t, g, unknown or other
  misc_feature (400)..(400): n is a, c, g, or t
  modified_base (436)..(436): a, c, t, g, unknown or other
  misc_feature (436)..(436): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaagccaggccagtcccctgtggtggtcatctatcaagaccacaagccgccctcggggatacccgtgagcgattctctggcctccacctcgtacgggaactacgagcccacgtctcgaccatcagcgggacgcaggctagnggatgaggctgtactttatgcgaggtcggtgggacnggcgacacgtcggccggttggttccgggacgggtaacggggacccaaacggccgtacggaacccggttcccgtacgggtccacggtcccgaacggtccctccccgg

SEQ ID NO: 333830 - DNA, 537 bp, Homo sapiens
  misc_feature: GZ8MTXP02HE7GL.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (426)..(426): a, c, t, g, unknown or other
  misc_feature (426)..(426): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataattgcgagataaatatgctgcctggtatcagcagagccaggccagtcccctgtggtggtcatctatcaagacaccaagccggcccgtcggggataccccgtgacgcgattctctgggcctccacctcgtagggacacgacgcccaactctcgaccactcgaaggcgggacgcgaggctgtggatgaggcttgtacgtttangtcgaggcgtaggacgagcgtacacgttcgcccggtggttccggacgggacggaccgaaggccgtacggaacccgtccgtcggtacgaccggacccgacggccgtccccgg

SEQ ID NO: 333831 - DNA, 558 bp, Homo sapiens
  misc_feature: GZ8MTXP02FTRUV.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (436)..(436): a, c, t, g, unknown or other
  misc_feature (436)..(436): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaattgngagataatatgctgcctggtatcagcagaagccagccagtcccctggtggtggtcatctatcaaagacaccaacgccggcccgtcggggactaccccgtgacgcgattctcgtcggcctccacctcgtacgggaacacacgcccactctacgaccatcgaggcggacgcgaggcgtgtggagtggaggtctaggtacttttacgngtacgagggcggtagggacaggacgacgtacgtcggccggttggttccgggacgggtacgggaccgaacggcgtacggaaccgtccgtacggtaccacggacccgaacggccgttcccccgg

SEQ ID NO: 333832 - DNA, 585 bp, Homo sapiens
  misc_feature: GZ8MTXP02FXUHW.51.60.F05.1.454.CMB.2.raw
  modified_base (351)..(351): a, c, t, g, unknown or other
  misc_feature (351)..(351): n is a, c, g, or t
  modified_base (445)..(445): a, c, t, g, unknown or other
  misc_feature (445)..(445): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaacgccaggccacgtcccctggtggtggtcatctatcaaagaccaccgaacggccggcccgtcggggactaccccgtgacgcgtattctcncggcctcccacctcgtacgggaaccacgacgcccactctcgaccatccgaggcgggacgcgaggctggtgagtgaggtctagttacttttacgngtacgagggtcggtgggacaggccgaacgcgtcggccggttgggttccgggacggggaacgggacccgaacggtccgtaccggtaacccgttcccggtaccgggtaccaccggtaccccgaacgggtcccgttcccccgg

SEQ ID NO: 333833 - DNA, 573 bp, Homo sapiens
  misc_feature: GZ8MTXP02H5F4K.51.60.F05.1.454.CMB.2.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (406)..(406): a, c, t, g, unknown or other
  misc_feature (406)..(406): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaatgcgagataaatntgctgcctggtatcagcagaagccaggccagtcccctggtggtgcatctatcagacacaagccggcctggggactacccgngagcgattctctcggcctcccactccgtaggggaaccacgacgcccactctcgaccatcgagccgggacgcgaggctggtacggntaggaggtcttaggtacttttacgtcggttcgagggtcggtagggacacggcgacgaccgtcggtccggttggttccgggacggggacgggacccgaacggtccgtacgggtaaccccggttcccgtaccgggtaccaccggtaccccgaacggtccctcccccggg

SEQ ID NO: 333834 - DNA, 492 bp, Homo sapiens
  misc_feature: GZ8MTXP02HY3EO.51.60.F05.1.454.CMB.2.raw
  modified_base (280)..(280): a, c, t, g, unknown or other
  misc_feature (280)..(280): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagagcaggccagtcccctgtgngtcatctatcagacacaagcgccctcggggatacccctgagcgattctctggctccactctgggaacacagccactctgaccatcagcgggacgcgagctgtggatgaggctgactttacgngtcaggtcgngggacagcgacacgtcgccggtgtcggcggacggaccaacgcgcgaaccgtccgtcggtcacgcccgaaggcctccccgg

SEQ ID NO: 333835 - DNA, 557 bp, Homo sapiens
  misc_feature: GZ8MTXP02JXIQS.51.60.F05.1.454.CMB.2.raw
  modified_base (343)..(343): a, c, t, g, unknown or other
  misc_feature (343)..(343): n is a, c, g, or t
  modified_base (410)..(410): a, c, t, g, unknown or other
  misc_feature (410)..(410): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgacgagataaatatgctgcctggtatcagcagaagccaggcccagtcccctggtggtggtcatctatcaagaccaccagccggcccgtcggggactaccccgtgagcgtattcncgtggcctccacctctagggaaccacgacgcccactcctgacccagtcaggcgggacgcgaggctgnggagtggaggtctgtacttttacgtgttcgagggtcggtagggacaggcgacgacgtcggtccgggttggttccggggcgggaacggggaccgaacggccgtacggaacccgtccgtacgggtccacggcccgaacggcgtccccgg

SEQ ID NO: 333836 - DNA, 575 bp, Homo sapiens
  misc_feature: GZ8MTXP02I8GT9.51.60.F05.1.454.CMB.2.raw
  modified_base (222)..(222): a, c, t, g, unknown or other
  misc_feature (222)..(222): n is a, c, g, or t
  modified_base (468)..(468): a, c, t, g, unknown or other
  misc_feature (468)..(468): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggtatcagcagaagccaggcccagtcccctgtggtggtcatctatcaagaccaccaacgccggccctcggggactaccccgtgacgcgtactttctcgtgggcctccacctcgtacggggaaccacgacgcccactctacgaccatcgacggcgggaccgcgagggtctgtggatggaggtcttggttaccttttacgagtcgagggcggttagggacncggacgacacgtcggccggtggttcggggacggacgggaccgaaacggtccgtaccggaaccggtcccgttacgggcccgacggaccccgtaacggcctcccccggg

SEQ ID NO: 333837 - DNA, 586 bp, Homo sapiens
  misc_feature: GZ8MTXP02IQQ7T.51.60.F05.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaacngccagcatcacctgctctgganataatgcgagataatatgctgcctggtatcagcagaagccaggccacgtcccctggtggtcggtcatcgtaatacaaagaccaaccaacggccggcccgtacggggactaccccgtagacgcgtacttcgtcgtcggcctcccgaccttcggtacggaaccacgacgtcccactcctacgaccctagtccgaaggtcgggaccgcgacgggtactgggtgagtacggaacggtccgtttagtacctttttacgacgtcggagggtcggtagggacaggccaacgcgtcggcggttcggtcggacgggtacggaccgagccgtacgtaacccgtcgtcggacaccggaccgacggtccgtccccgg

SEQ ID NO: 333838 - DNA, 599 bp, Homo sapiens
  misc_feature: GZ8MTXP02GXW3H.51.60.F05.1.454.CMB.2.raw
  modified_base (425)..(425): a, c, t, g, unknown or other
  misc_feature (425)..(425): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaaagccggcccgtcggggataccccgtgagcgattctctgggcctccacctcgtgggaaccacagccactctgaccatcagcgggacgcgaggctggtggatggaggcttgtactttttacgngttaccgagggtccggtggggacagggaccgaacgtccgtcgggtccccggttgggtttcccggggacggggtaacgggggacccgaaacgggtcccgtacgggtaacccccggttcccgttacccggggttaccgaaccggcccccgaaacggggtccccgtttccccccggg

SEQ ID NO: 333839 - DNA, 564 bp, Homo sapiens
  misc_feature: GZ8MTXP02ICX56.51.60.F05.1.454.CMB.2.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (320)..(320): a, c, t, g, unknown or other
  misc_feature (320)..(320): n is a, c, g, or t
  modified_base (370)..(370): a, c, t, g, unknown or other
  misc_feature (370)..(370): n is a, c, g, or t
tcagcgatcgtatacacgaccggtgctcgatttagtacgtcatcagggaaagtggctgggcctcaggaagcagcatcggaggtgcctcagccatggcatggatccctctcttcctcggcgtccttgcttactgcacaggatttgtggcctcctatgagctgattcagccaccctnagtgtccgtgtccccaggacaaacngccagcatcacctgctctgganataatgcgaagataaatatgctgcctggatcagcagagcagccagtccctgtggtgtcattctatcaagacaccaagccggcctggggaccttaccgngacgcgtacttctcgtcgcctcccaccgtcgacggaacacacgacctacnctacgacacacgacggcggacgacgcggtcgtggtaggagtaggacggtacgttacgttaccgttttacgtacggtcggtacgggcgggtacggacgacggtaccgacgtacgtcggtccggttcggtccggggacgggacggaccgaacgcgtccggtaccgtccgtacggtaccgaccgacccgacggcccg

SEQ ID NO: 333840 - DNA, 533 bp, Homo sapiens
  misc_feature: GZ8MTXP02IZLE1.51.60.F05.1.454.CMB.2.raw
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataattgcgagaataatatgctgcctggtatcagcagaagccaggccagtcccctgtggtggtcatctatcaagacaccaagccggcctacggggatacccctgagcgacttctctcggctccacctcgtacggggaaccacacgcccaactctacgaccatcgagacgggaccgcgaggctgnggagtgnggctgtactttacgngtcgagggcgtgggacngacgacgactcggcgtggttcgggacgggacgggaccgaacgcgtacgaaccggtcccgtcggtaccacgcccgaacggccctcccgg

SEQ ID NO: 333841 - DNA, 683 bp, Homo sapiens
  misc_feature: GZ8MTXP02GS9WA.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctcgtggagataattgacgagaataatatgctgcctggtatcagcagaacgccgaggccacgtcccctggttggtggtctatctatacaaacgacaccgaacgccggacccgtcggggactacccgtgacgcgatttcctcgtcggcctcccaccgtcgtacgggaaccacgtacgcccaacctctacgacccactccgaacgggccgggaccgcgacgggtccgttagggtgggtaagtcgggtaacggtccgttacggtttaaacctttttacggtacggtaccggtaggggtacccggttagggggaactaccccccgggagtaacccgaccgttcggggtccccgggttggggttacccgggggaccggggacggggaaacccgaacgggtcccgttaccggtaaccccggttcccgtaccgggtaccgacccggtaccccggaacggtcccgtttccccccggg

SEQ ID NO: 333842 - DNA, 516 bp, Homo sapiens
  misc_feature: GZ8MTXP02FRWD1.51.60.F05.1.454.CMB.2.raw
  modified_base (334)..(334): a, c, t, g, unknown or other
  misc_feature (334)..(334): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtcccaggacaaacagccagcatcacctgctctggagataaattgcgcgatagatatgttcctggtatcaacagaagccaggcccagtcccctgtcgtggtcatctatcaagacaccaagcggccctcagggatccctgagcgattctcnggctccaactctgggaacacagccactctgaccatcagcgggacgcaggctgtggatggaggtctgtacttttacgtgtcgagggcggtgggacaggacgacacgtcggccggtgttcggggccgggggacaacggctcggaccgtccgtcggtcacgccccgaaggctccgccccctccgg

SEQ ID NO: 333843 - DNA, 576 bp, Homo sapiens
  misc_feature: GZ8MTXP02FL7HQ.51.60.F05.1.454.CMB.2.raw
  modified_base (455)..(455): a, c, t, g, unknown or other
  misc_feature (455)..(455): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgacgagataaatatgctgcctggtatcagcagaagccaggccacgtcccctggtggtggtcatctatacaaagaccaaccgaaacgccggacccgtacggggtactaccccgtgacgcgattccgtctcggtcctcccacctcgtacgggaaccacgacgcccaactctacgaccactcgagcggacgcgacggcgtgtgatgggaggtccttggtactttttagngtacgaggtcggtagggacagacgtacacgtcggaccggttggtcgggacgggacgggaccgaacggccgtacggaacccgttccgtacggtaccgaccggacccgacggtccgtccccgg

SEQ ID NO: 333844 - DNA, 641 bp, Homo sapiens
  misc_feature: GZ8MTXP02F0D3A.51.60.F05.1.454.CMB.2.raw
  modified_base (200)..(200): a, c, t, g, unknown or other
  misc_feature (200)..(200): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatatgctgcctggtatcagcagaagccaggccagtcccctggtggtggtcatctatcaagacaccgaaggccggcccgtcgggggactaccccgtggacgcgtacttcctcgttcggcctccacctcgtacgggaaccacgacgaccctactcgtacgaccactcgaggccgggacgacgacggtcgtaggtggagtacggaggtacgttagtttaccgtttttacgtggttaccggaggggtccggtaggggaaccgacggtaccgaacgtcggtcgggtcccgggttcgggttaccgggggaccgggggtaacgggaacccgtaacggcccggttaccggaaccccggttcccggtaccgggtaccgacccggacccggtaacggtcccgttccccccggg

SEQ ID NO: 333845 - DNA, 608 bp, Homo sapiens
  misc_feature: GZ8MTXP02FRLT7.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (456)..(456): a, c, t, g, unknown or other
  misc_feature (456)..(456): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataaattgacgagataaatatgctgcctggtatcagcagaacgccaggccacgtcccctggtggtggtcatctatcaagacaccgaacggccggcccgtacggggactaccccgtgagcgtactttctcgtcggcctcctaccgtcgtacgggaacctacgacgcccactctcgaccatcgaaggccggacgcgaggtcgtggtgggatgggacgtcgttgttacttttacgngttccgagggtccggtaggggactacgggacgaaccgtcggtcggtccgggttcgggttaccggggacggggaaccgggaccgaacggccggttacggaacccggttcccgtacggtaccgaccggaccccgaacgggcccgtttcccccgg

SEQ ID NO: 333846 - DNA, 539 bp, Homo sapiens
  misc_feature: GZ8MTXP02FPGGY.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (340)..(340): a, c, t, g, unknown or other
  misc_feature (340)..(340): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtcccccaggacaaacngccagcatcacctgctctgganataaattgcgagataaatatgctgcctggtatcagcagagccaggccagtcccctggtggtgtcatctatcaagacaccgaagccggccgtcggggactaccccgtgacgcgattcncgtggcctcccactcgtacgggaaccacgacgcccactctacgaccatcgagcgggacgcgaggctgtggatgagtctgtactttagngtcgaggcgtgggacngcgactacgtcggtcccggtggttccgggacgggtacggaccgaaggcctacggaacccgtccgtcggtcaccggacccgaacggccgtccccgg

SEQ ID NO: 333847 - DNA, 548 bp, Homo sapiens
  misc_feature: GZ8MTXP02HWLYH.51.60.F05.1.454.CMB.2.raw
  modified_base (201)..(201): a, c, t, g, unknown or other
  misc_feature (201)..(201): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgacgagataaatatgctgcctggtatcagcagaagccaggccagtccccctggtggtggtcagtctatacaagacaccaaagccggccccgtcggggatacccctgacgcgattctctgggcctcctacctctcgggaaacaccacgcccactctacgacccagtcgagcgggacgcgaggctgngatggngacttgtacttttacngtcgaggcggtggacagcgacacgtcgcgttagggtcggcgggtaacggaccgtaacgcgtcggaacccgtcccgtacgggtccacggtaccccgaaggtccctcccccgg

SEQ ID NO: 333848 - DNA, 495 bp, Homo sapiens
  misc_feature: GZ8MTXP02FYW21.51.60.F05.1.454.CMB.2.raw
  modified_base (108)..(108): a, c, t, g, unknown or other
  misc_feature (108)..(108): n is a, c, g, or t
  modified_base (145)..(145): a, c, t, g, unknown or other
  misc_feature (145)..(145): n is a, c, g, or t
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagcgatcgtatacacgaccggtgctcgatttagtacgtcatcagggaaaggggctgggcctcaggaagcagcatcggaggtgcctcagccatggcatggatccctntcttcctcggcgtccttgcttactgcacaggatttgnggcctcctatgagctgattcagccacctcagtgtccgtgtccccaggacaaacngccagcatcacctgctctggagataaattgcgagataaatatgctgcctggtatcgagcagtaagccaggccagtcccctgtggtggtcatctatcaagacacgaagcgccnggggactacccgtgancgacttcnctggcctccactntcgggaacacacgccactcgcacatcagcggacgcgaggctggngagtgagctgtacttacgngtcgnggcgagacgcgacgacgcgtcgcgtcgtcggacggacggacgacgcgtacgccgtccgcgacacgaccgacgccgtccg

SEQ ID NO: 333849 - DNA, 585 bp, Homo sapiens
  misc_feature: GZ8MTXP02FXABK.51.60.F05.1.454.CMB.2.raw
  modified_base (423)..(423): a, c, t, g, unknown or other
  misc_feature (423)..(423): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgacgagaataaatatgctgcctggtatcagcagaagccaggccacgtcccctggtggtgtcatctatcaaagaccaccgaaacgccggcccgtacggggactaccccgtgacgcgtattcctcgtggcctccacctcgtacgggaaccacgacgcccactctacgaccagtcgaggcgggacgcgaggcgtagnggagtggaggtcgttagttacttttacgtgttccgagggccggtaggggacaggaccgaacgcgtcggtccgggttggttaccgggacggggacgggaccgaacggccgtaccggaacccggttccgtcggtacgaccggaccccgaacggccgtcccccgg

SEQ ID NO: 333850 - DNA, 539 bp, Homo sapiens
  misc_feature: GZ8MTXP02I132L.51.60.F05.1.454.CMB.2.raw
  modified_base (278)..(278): a, c, t, g, unknown or other
  misc_feature (278)..(278): n is a, c, g, or t
  modified_base (362)..(362): a, c, t, g, unknown or other
  misc_feature (362)..(362): n is a, c, g, or t
  modified_base (403)..(403): a, c, t, g, unknown or other
  misc_feature (403)..(403): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtcccccaggacaaacagccagcatcacctgctctggagataaattgcgagataaatatgctgcctggtatcagcagaagccagccagtccccngtggtggtcatctatcaacgacacaacgcgccccgtcggggataccccgtgagcgattctctggcctccacctcgtcgggaacncgagtcccacgtctagaccatcgagcgggacgcacggctgngagtgaggctgtactttctagtcagggcgtggggacaggcgacgacgtcgccggttggttccgggacgggaacgggaccgaaacgccgtcgaacccggttccaccgggtacgacgcccgaacgggtccctccccgg

SEQ ID NO: 333851 - DNA, 653 bp, Homo sapiens
  misc_feature: GZ8MTXP02GQHD2.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataattgcgagataatatgctgcctggtatcagcagaagccaggccagtcccctggtggtggtcatctatacaagacaccaaggccggcccgtacggggactaccccgtggacgtcgtactttcgtccgtcgggtccctacccaccgttcgtaacgggaaccacgacgccctactcctacgaaccacgtcgacgggacgggaccgacgacggcgttaggaggtacgtagggacggtcttacggtttaccgtttttacgtcggttaccggacgggggtacggttacgggggaaccaggacccgacgtacggtccggtccgggttcggggttaccggggaccgggtaacggggacccgaaacggccgttaccggaacccggttcccggtaccggtaccgtaccggacccggtaacggtcccgtaccccccgg

SEQ ID NO: 333852 - DNA, 544 bp, Homo sapiens
  misc_feature: GZ8MTXP02GQTYP.51.60.F05.1.454.CMB.2.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (331)..(331): a, c, t, g, unknown or other
  misc_feature (331)..(331): n is a, c, g, or t
  modified_base (426)..(426): a, c, t, g, unknown or other
  misc_feature (426)..(426): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaacngccagcatcactgctctganataattgcgagataaatatgctgcctggtatcagcagaagccaggccagtcccctgtggtgtcatctatcaagacaccaagcgcccgtcggggataccccgtgagcgattcncttggcctccacctcgtagggaaccacacgcccactctacgaccatcacggcgggacgcgacggctggtggattggaaggtctgtacttttacgngttcgaggtcggtgggacacggcgacgacgtcggccggttggttccgggacgggacgggaccaacggccgttacggaacccgtccgtaccggtacgacgacccgaacggtctccccgg

SEQ ID NO: 333853 - DNA, 597 bp, Homo sapiens
  misc_feature: GZ8MTXP02F3ZCH.51.60.F05.1.454.CMB.2.raw
  modified_base (200)..(200): a, c, t, g, unknown or other
  misc_feature (200)..(200): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataattgcgagataaatatgctgcctggtatcagcagagcagccagtccccngtgtgcatntatcaagacaccaagcggccctcggggactacccgtgagcgtacttctctgggcctacccacctcgtacgggaacacgacgccaactctacgacccatacgaggacgggaccgacgacgggtcctggtggtagtcggacggtcgttagttaccgtttttaacgtcgttaccgaaggggtcggttacgggggaactacgggccgacgaacgtcggtcccggtgggttccggggacggggtacggggaccgaacgggcgttacgggaacccgttccgtaccggggtcaccggtacccgaacggtcccgttccccgg

SEQ ID NO: 333854 - DNA, 551 bp, Homo sapiens
  misc_feature: GZ8MTXP02F3K1J.51.60.F05.1.454.CMB.2.raw
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataaatatgctgcctggtatcagcagaagccaggccagtcccctggtcggtgtcatctatcaaagacaccgaagccggccgtcggggactacccgtgacgcgtattcgtcgtggcctccacctcgtacgggaaccacacgcccactctcgaccatcaggcgggacgcgaggctgtggagtggaaggcttggtacttttacgtgtaccgaggcggtgggacgagacgacacgtcggccggttggttccggggacgggacggaccgaaacgccgtacgaacccgtccgtacggtcacgacccgaacggcccgtccccgg

SEQ ID NO: 333855 - DNA, 583 bp, Homo sapiens
  misc_feature: GZ8MTXP02IN5H8.51.60.F05.1.454.CMB.2.raw
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
  modified_base (283)..(283): a, c, t, g, unknown or other
  misc_feature (283)..(283): n is a, c, g, or t
  modified_base (411)..(411): a, c, t, g, unknown or other
  misc_feature (411)..(411): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcagataaatatgctgcctggtancagcagaacgccaggccagtcccctgtggngtcatctatcaagacacgaacgccggcccgtaggggactaccccgtgacgcgtattccgtcgtggcctccctaccgtcgtaacgggaccacgacgcccactctacgaccactcgacggcgggacccgnggacggcgtggtggagtggacggtcttgttaacctttttgcgtccgaaggcgggttagggaacgacggccgaacgtacgtcggacccggttgggttacccggggacggacggggaccaacggcgtacggtaacccgtcgtaccggtcaccggtacccgacggcgtcccccgg

SEQ ID NO: 333856 - DNA, 529 bp, Homo sapiens
  misc_feature: GZ8MTXP02GM921.51.60.F05.1.454.CMB.2.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
tcagcgatcgtatacacgaccggtgctcgatttagtacgtcatcagggaaagggctgggcctcaggaagcagcatcggaggtgcctcagccatggcatggatccctctcttcctcggcgtccttgcttactacacaggatttgtggcctcctatgagctgattcagccaccctcagtgtccgtgtccccaggacaaacngccagcatcacctgctctggagataaatgcgagataaatntgctgcctggtatcagcagaagccaggccagtcccctgtggtggtcatctatcaagacaccaagccggcctcggggatacctgacgcgattctctggctccacctctaggggaaccacgacgccactctgacccatcaggccgggacgcgaggctggtcggagtggaggtctaggtacttttacgtggttacgagggtcggtaggggacaggaccgacacgtcgccgttggttccgggcggagggaccagcgtcgaccgtcgcggtcacgcccgacggcctcgtcccccg

SEQ ID NO: 333857 - DNA, 534 bp, Homo sapiens
  misc_feature: GZ8MTXP02G7736.51.60.F05.1.454.CMB.2.raw
  modified_base (312)..(312): a, c, t, g, unknown or other
  misc_feature (312)..(312): n is a, c, g, or t
  modified_base (439)..(439): a, c, t, g, unknown or other
  misc_feature (439)..(439): n is a, c, g, or t
  modified_base (468)..(468): a, c, t, g, unknown or other
  misc_feature (468)..(468): n is a, c, g, or t
  modified_base (512)..(512): a, c, t, g, unknown or other
  misc_feature (512)..(512): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagccggccnggggataccccgtgagcgattctctgggcctccaccctcgtaggggaaaccacagcccaactctacgacccatccgagccggggacgcgagggtctggtggagttggaggtcttgtactttttacgngtcgaggggtcgtggggacaggccgaacncgtcgccggtgttcgggcggacgggacaagcgtcgaaccgtccncggtcacgccaaggcctcccgg

SEQ ID NO: 333858 - DNA, 580 bp, Homo sapiens
  misc_feature: GZ8MTXP02JH90X.51.60.F05.1.454.CMB.2.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
tcagcgatcgtatacacgaccggtgctcgatttagtacgtcatcagggaaaggggctgggcctcaggaagcagcatcggaggtgcctcagccatggcatggatccctctcttcctaggcgtccttgcttactgcacaggatttgtggcctcctatgagctgattcagcccaccctcagtcgtccgtcgtccccaggacaaacngccagcatcacctgctcngganataatgcgagaataaatatgctgcctggtatcagcagaacgccgaggccacgtcccctggtggtggtcatctatacaaacgacaccgaaggccggccgtacggggactaccccgtgacgcgtattctcgtcgcctccacctcgtacggaaccacgacgcccactcgtacgaccatcgacggcggaccgcgaggtcgtggtggagtggaggtcgttaggtaccttttacgtcgtcgacgggtcggtacgggacgacggacgacgacgttcggccggttgggtccggggacgggacgggaccgaacggccgtacggaacccgtcgtccggtacgacgacccgacggtccgtccccgg

SEQ ID NO: 333859 - DNA, 597 bp, Homo sapiens
  misc_feature: GZ8MTXP02FOVK9.51.60.F05.1.454.CMB.2.raw
  modified_base (199)..(199): a, c, t, g, unknown or other
  misc_feature (199)..(199): n is a, c, g, or t
  modified_base (460)..(460): a, c, t, g, unknown or other
  misc_feature (460)..(460): n is a, c, g, or t
  modified_base (484)..(484): a, c, t, g, unknown or other
  misc_feature (484)..(484): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtcccaggacaaacngccagcatcacctgctctggagataaattgcgagataaatatgctgcctggtatcagcagaagccaggccagtcccctggtggtggtcatctatcaaacgacaccaaagccggccctcggggactaccccgtgacgcgtattctctcgggtcctccctacctctacggggaaccacgacgcccaactctcggaacccagtcacgcggggaccgacgagggcctagggtggaattggaagggtcctgtaaccgtttttacgngttcgaagggtccggtggggaacnggaccgacacgtcggcccggttaggttcccgggacgggacggggacccgaacggtccgtacggtaaccccgtccggtccggtacgaccggtacccgaacggccttacccccgg

SEQ ID NO: 333860 - DNA, 653 bp, Homo sapiens
  misc_feature: GZ8MTXP02JBOUW.51.60.F05.1.454.CMB.2.raw
  modified_base (176)..(176): a, c, t, g, unknown or other
  misc_feature (176)..(176): n is a, c, g, or t
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctactatgagctgattcagcccaccctnagtcgtccgtcgtccccaggacaaacngccagcatccacctgctctgganataatgacgagaataatatgctgccgtggtatcagacagaacgccgacggccacgtcccctggtcggtggtcactctatacgaaacgaccaaccgaacggccgacccggtacggggactacccgtagacgcgtacttcgtcgtcggccctccaccgtcgtacgggaaccacgaccgaccctactcctaccgaccctacgtaccgacggggacccgggacgacggaacgggtcgtgggtaggtacggtagggtacggtcgtttagtttaccgttttacggtcggtaacggcgggtacggggtacggacgacggaccgtaaccgtcggtccggtccggttcggggtaccggggacgggacgggtaccaacggtccgtaccggtccccgtccggtaccgacggaccgacccgtacggtcccgtcccccgg

SEQ ID NO: 333861 - DNA, 716 bp, Homo sapiens
  misc_feature: GZ8MTXP02HQ3OB.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctggtggtggtcatctatcaagaccaaccgaaaggccggccccgtcgggggaacttaccccccgtggacgtcggtatttcctcgttcgggcccttcccgtaacctccgttacgggggaaaccaccgaaacggcccccacctttccgccggaaacccctagttacccggaagggcccgggggaaaccgccgaacggggtccgttagggttacggggattggggaacgggttccgtttagggttacctttttaacggttggtccggaacggggtcgggtagggggaccgacgggaccgtaccgaaccgttcggcccgggtttggggtttacccgggacgggggtaacggggacccgtaacgggtcccgtacggaacccccgggttttccgcccggggttacccgaacgggtacccccgaaacggggttcccgtcccccgggg

SEQ ID NO: 333862 - DNA, 521 bp, Homo sapiens
  misc_feature: GZ8MTXP02IZSU1.51.60.F05.1.454.CMB.2.raw
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagagcaggccagtcccctgtggtggcatctatcaagacaccaagcgccctcggggactaccccngacgcgattcnctgctccaccttcaggaacacacgcccactctgacccactcgacgcgggacgcgaggctggnggatggaggctagtactttactgtcgnggtcgtgggacncggcgacncgtcggcgtggttcgggacggacgggaccaacgtccgacgtaacccgtccgcggtccacgccccgaaggtcctccccgg

SEQ ID NO: 333863 - DNA, 548 bp, Homo sapiens
  misc_feature: GZ8MTXP02HQ8OP.51.60.F05.1.454.CMB.2.raw
  modified_base (201)..(201): a, c, t, g, unknown or other
  misc_feature (201)..(201): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgacgagataaatatgctgcctggtatcagcagaacgccaggccagtcccctggtggtggtcatcatcaagacacaagccgcccgtggggactacccgtgagcgattctcgtgcctccactcgtacgggaacacagacccactctacgaccagtccgaggcgggacgcgacggcgtggtggatggagtcttagtacttttacgngtcgaggcgtgggacngacgacacgtcgccgttggtcggacggacgggacccgaaggtccgtacggaacccgttccgtaccgggtaccaccggaccccgaacggtccgtccccgg

SEQ ID NO: 333864 - DNA, 552 bp, Homo sapiens
  misc_feature: GZ8MTXP02JYOM6.51.60.F05.1.454.CMB.2.raw
  modified_base (176)..(176): a, c, t, g, unknown or other
  misc_feature (176)..(176): n is a, c, g, or t
  modified_base (223)..(223): a, c, t, g, unknown or other
  misc_feature (223)..(223): n is a, c, g, or t
  modified_base (373)..(373): a, c, t, g, unknown or other
  misc_feature (373)..(373): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctnagtgtccgtgtccccaggacaaacagccagcatcacctgctctgganataatgcgagataatatgctgcctggtatcagcagaagccaggcccagtcccctgtggtggtcatctatcaagacaccaagcgcctcggggataccccgtgagcgattctctggcctccactcgtgggaacacagcccactctgaccacncgagcggacgcgaggcgtggtaggagtggacggtacgtacgttacgtttacgttacgtacgacgggtacggtacgggacggacggacgacgacgtcggtccggtcggtccgggacgggacgggaccgacgtacgtccgtaaccgtccgtaccggtacgaccgaccgaccggaccgtccg

SEQ ID NO: 333865 - DNA, 660 bp, Homo sapiens
  misc_feature: GZ8MTXP02HEFY1.51.60.F05.1.454.CMB.2.raw
  modified_base (201)..(201): a, c, t, g, unknown or other
  misc_feature (201)..(201): n is a, c, g, or t
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgcgagataaatatgctgcctggtatcagcagaacgccgaggccagtccccgtgtggtggtcaagtctatcaagacacaacggcgcccgtcggggatccccgtgagcgattcnctcggcctccacctcgtagggaacncgaacgcccaacgtcctacgacccacgtcgaacgggccgggaaccgccgtaagggcccgtttagggtaccgggagttagggaacggtccgtttggttaaacctttttaccggaggttcccggaaggggtccgggttaggggaccaacgggtccgaaactaccggtcgggtacccggtttacggggttccggggaacgggggacggggtaacccgtaaacgggcccgttaccggaaccccggttccgttacccgggtacgacccggaccccggaacgggtccccgtcccccggg

SEQ ID NO: 333866 - DNA, 556 bp, Homo sapiens
  misc_feature: GZ8MTXP02HOFN4.51.60.F05.1.454.CMB.2.raw
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
  modified_base (463)..(463): a, c, t, g, unknown or other
  misc_feature (463)..(463): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcactgctctggagataaattgacgagataaatatgctgcctggtatcagcagaagccaggccagtcccctgtggtggtcatctatcaagacaccgaagccggaccctcggggactaccccgtgacgcgtattctcctgggcctaccacctcgtacgggaacacgagcccaactctacgaccatcagcgggacgcgaggctagnggatggagtcgtagtacgtttacngtacgagggtcgtgggacaggcgaacncgtcgtcggttggttacgggacggacggaaccgacggtccgtacgtaaccgtcccggtacggtccaacggcccgtaacggccgtttcccccgg

SEQ ID NO: 333867 - DNA, 584 bp, Homo sapiens
  misc_feature: GZ8MTXP02HIK9V.51.60.F05.1.454.CMB.2.raw
  modified_base (203)..(203): a, c, t, g, unknown or other
  misc_feature (203)..(203): n is a, c, g, or t
  modified_base (470)..(470): a, c, t, g, unknown or other
  misc_feature (470)..(470): n is a, c, g, or t
tcagcgatcgtatacacgaccggtgctcgatttagtacgtcatcagggaaaggggctgggcctcaggaagcagcatcggaggtgcctcagccatcggcatggatccctctcttcctcggcgtccttgcttactgcacaggatttgtggcctcctatgagctgattcagcccaccctcagtgtccgtcgtccccaggacaaacngccagcatcacctgctctggagataaatgacgagataaatatgctgcctggtatcagcagaagccaggccacgtcccctggtcggtggtcatctatacaaagaccaaccgaacggccggaccccgtacgggggaactaccccgtggaacgcgtactttcctcgttcgggcccttcctacccgtcgtacggggaaaccacgacgcccaactcctacgaccatcgaggccgggacgcgaggcctgtggatggagtcgtgtactttacgngtcgagggcgtagggacagccgacgacgtcggccgttaggtccggacgggacgggaccgaacggctacggaacccgtccgtcggaccgacgacccggaacggtccgtcccccgg

SEQ ID NO: 333868 - DNA, 581 bp, Homo sapiens
  misc_feature: GZ8MTXP02HKGFW.51.60.F05.1.454.CMB.2.raw
  modified_base (198)..(198): a, c, t, g, unknown or other
  misc_feature (198)..(198): n is a, c, g, or t
  modified_base (455)..(455): a, c, t, g, unknown or other
  misc_feature (455)..(455): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtcccaggacaaacngccagcatcacctgctctggagataaattgacgagataatatgctgcctggtatcagcagaacgccaggccacgtccccgtggtggtgtcatctatacaaagaccaccgaacggccggacccgtacggggactaccccgtgacgtcgtacttctcgtcggcctcccaccgtcgtacgggaaccacacgcccactctacgaccagtcgacgcgggacgcgacggcgtggtggagtggacggtcttagtacttttacgngtcgagggtcggtgggacacggacgacgtacgtcggtccggttggtccgggacgggtacggaccgacgtccgtacggtaacccgttccggtccggtacgaccggtaccccgacggtccctccccgg

SEQ ID NO: 333869 - DNA, 634 bp, Homo sapiens
  misc_feature: GZ8MTXP02FRNKN.51.60.F05.1.454.CMB.2.raw
  modified_base (199)..(199): a, c, t, g, unknown or other
  misc_feature (199)..(199): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (437)..(437): a, c, t, g, unknown or other
  misc_feature (437)..(437): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctctatgagctgattcagccaccctcagtgtccgtgtccccaggacaaacngccagcatcactgctctgganataaatgcgagataaatntgctgcctggtatcagcagaacgccaggccacgtcccctggtggtgtcatctatacaaaagaccaaccgaaacgcccggacccgtacggggtactaccccgtagacgcgtaacttcgtcgtcggtcctaccctaccgtcgtacggggaaccaacgacgtacccactctacaccgagtcgaggtacgggaccgagacggngttagggtggtaggtaggtacggtacgttacgttacgtttacgtacgtacggtacgggtacggtacggaacgacggacgacgtacggtacggtcggttcgggtacggggaccggggaaccgggtaaccgtaacgaccggtaccggtaaccggttaccggtaccggtaccggacccgaccggtaccggtaccgtcccg

SEQ ID NO: 333870 - DNA, 705 bp, Homo sapiens
  misc_feature: GZ8MTXP02G8R3E.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgaagaataaatatgctgcctggtactcagcaagaacgccaggccacgtcccctggtcggtgtcatctatcaaagacaaccgacggccggcccgtacggggactaccccgtagacgtcgtactttcgtcgtcgggccctccgtacccgtccggtacggggaaacccaccgaccggtacccctaccgtccgtacggaaccctacgtacccgaacggggccgggggaaccgcgaacggggtcgtacggggtagggaacgtgggtaacgggtcgtttacggtttaacctttttacggtcggttaccggtaaggggtccgggttaacggggaacgtacgggacccgtaacgtaccggttccggttcccgggttgggttcccgggggacggggaaacggggtacccgaaacggtccgtacggaaccccggttccgtacccgggtacgacccggacccgtaaccgggtcccgttcccccgg

SEQ ID NO: 333871 - DNA, 637 bp, Homo sapiens
  misc_feature: GZ8MTXP02GWFJY.51.60.F05.1.454.CMB.2.raw
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (402)..(402): a, c, t, g, unknown or other
  misc_feature (402)..(402): n is a, c, g, or t
  modified_base (452)..(452): a, c, t, g, unknown or other
  misc_feature (452)..(452): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtcgtccccaggacaaacagccagcatcacctgctctgganataatgngagataatangctgcctggtatcagacagacgccgaggcccacgtcccctggtcggtgtctatctatacaacgaccaaccgaacggcccggacccgtacggggtactaccccgtggacgcgtactttcgtcgtacggccctccctaccgtcggtacgggaacctacgacncccgtaacttcacgaccacgtacgacggcgggaccgcgacggtcgtaggnggtagtgggtacgtcgttagttacgtttacgtggtacgtagggtcgggtaggaaccgcggtaccgaacgccggttcggccggtttacgggtcccggggaacgggaaccgggaacccgacgggtccgtaccggaaccgtcccggtacggtacggacccgacccggtacggtccccgtacccccggg

SEQ ID NO: 333872 - DNA, 577 bp, Homo sapiens
  misc_feature: GZ8MTXP02IN80R.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtgtccgtgtccccaggacaaacngccagcatcacctgctctgganataatgcgagataatatgctgctggtatcagcagacgccaggccacgtcccctggtggtgtcatctatcaaagaccaccgaaggccggcccgtaggggactacccgtgacgcgtattcctcgtcggcctaccacctcgtacgggaaccacgacgcccactctacgaccactcgagacgggaccgacgaggctggtaggactggacggcttacgttacttttacgacgtcgagggtcggtacgggacaggtacgacacgtcggccgttggttccggggacgggtacgggaaccgaacggtcgtaccggtaaccgtcccggttcggtaccgacggacccgtaacggccgtaccccgg

SEQ ID NO: 333873 - DNA, 676 bp, Homo sapiens
  misc_feature: GZ8MTXP02GICOK.51.60.F05.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcacctgctctgganataatgacgagaataaatatgctgcctggtatcagcagaacgccaggccacgtcccctggtggtgtcatctatcaaagaccaaccgaagccggacccgtacggggactaccccgtgacgcgtattctcgtcggcctccacctcgtaggaaccacgacgacccactctacgacccagtaccgacggccggggaccgcgaacggggtccgtgggtaggtaagttacggacgggtacgtttacggttaaccttttttacggacggttaccgtacgggggtacgggttacgggggaaccgtacggggaccggaaaaccgtaccggttccgggtacccgggtttcggggttacccggggaacgggggaaccgggaacccggaaacggtcccggtacggtaacccggttcccggtacgggtaccgaccggaccccgaacggggtcccttcccccgggg

SEQ ID NO: 333874 - DNA, 541 bp, Homo sapiens
  misc_feature: GZ8MTXP02IIVTS.51.60.F05.1.454.CMB.2.raw
  modified_base (201)..(201): a, c, t, g, unknown or other
  misc_feature (201)..(201): n is a, c, g, or t
  modified_base (367)..(367): a, c, t, g, unknown or other
  misc_feature (367)..(367): n is a, c, g, or t
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgacgagataaatatgctgcctggtatcagcagaacgccaggccagtcccctggtggtgtcatctatcaagacacaagccggccctggggactaccccgtgacgcgattctcgtggcctccacctcgtacgggaaccncacgcccactcacgaccatcaggcgggacgcgaggcttggngagtcggaggtcttaggttaccttttacgngttcgagggcgtgggacagccgacgacgtcggccgttggtcggacgggacggaccgaacggtcacggaaccgttcgacggtcacggcccaaggtcctccccgg

SEQ ID NO: 333875 - DNA, 561 bp, Homo sapiens
  misc_feature: GZ8MTXP02JYFS5.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgcgagataatatgctgcctggtatcagcagaagccaggcccagtccccngtggtggtcatctatcaagacaccaagcggccctcggggataccccgtgacgcgtattctcgtcggcctcccgaccttcgtagggaacacgacgccctacgtctacgacccagtccgaacggcgggacgcgtacgggcctggtaggagtggacggtctagttactttacgtgtacgacgggtcgtaggggacaggcgaactcgtcggccggttggtccgggacgggacggaccgacgccgttacggaacccgtccgtacggcacggacccgacggcctccccgg

SEQ ID NO: 333876 - DNA, 617 bp, Homo sapiens
  misc_feature: GZ8MTXP02H9JWN.51.60.F05.1.454.CMB.2.raw
  modified_base (200)..(200): a, c, t, g, unknown or other
  misc_feature (200)..(200): n is a, c, g, or t
  modified_base (441)..(441): a, c, t, g, unknown or other
  misc_feature (441)..(441): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcactgctctggagataaatgacgagaataaatatagctgcccgtggtatcagcaagaagccgacggccacgtccccctggtggtcggtcatctaatacaagaccaacgaacgccggcctacggggactaccccgtgacgcgtatttctcgtcggtcctaccgtacctcgtacgggaaccaccgacgtacccacttcgacgaccctactcgacggcggacgcgaacgggctggnggagttgggagtacgtttgttaacgttttcgtggttaccgagggtacggtacgggacgaggaccgaacgtcgtcgggtccggttcgggttacgggccggggaaacgggaccgtaacggccgtacggtaacccggtccgttacggccgaacggccccgaacggtcccggtcccccgg

SEQ ID NO: 333877 - DNA, 556 bp, Homo sapiens
  misc_feature: GZ8MTXP02I13CE.51.60.F05.1.454.CMB.2.raw
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaancaggccagtccccngtgtgtcatctatcaagacaccaaacgcggacccctggggactaccccgtgagcgaattctctggcctccaacctcgtacgggaacacagcccaacttcacgaccaacncgacggcgggacgacgagcgtgnggtagtggacggtcttagttacctttacgtgtacgtaggtcggtaggacgagacgacgacgtcggtcgtcggtcgggacgggacgggaccgacggtccgtacgaacccgttccgtacggtacgaccggaccgtaacggtcctacccg

SEQ ID NO: 333878 - DNA, 565 bp, Homo sapiens
  misc_feature: GZ8MTXP02JCDEF.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (416)..(416): a, c, t, g, unknown or other
  misc_feature (416)..(416): n is a, c, g, or t
  modified_base (452)..(452): a, c, t, g, unknown or other
  misc_feature (452)..(452): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgganataatgcgagataatatgctgcctggtatcagcagaagccaggccagtcccctggtggtggtcatctatcaagacaccaagccggcctacggggactaccccgtgacgcgattctcttcgggcctccaccttcgtacggggaacctacgacgcccaacctctacgacccagtccaggcgggaccgcgaggtcnggtgagtggaggtctggtacttttagtcgttacggnggtacggtcggggacaggacgacgacgttcggacgggtcgggttcgggacggggaacgggaccaacggccgtacggaaccgttccgcggtacaccggccgaacggctccccgg

SEQ ID NO: 333879 - DNA, 579 bp, Homo sapiens
  misc_feature: GZ8MTXP02HUWOA.51.60.F05.1.454.CMB.2.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (338)..(338): a, c, t, g, unknown or other
  misc_feature (338)..(338): n is a, c, g, or t
  modified_base (421)..(421): a, c, t, g, unknown or other
  misc_feature (421)..(421): n is a, c, g, or t
tcagcgatcgtatacacgaccggtgctcgatttagtacgtcatcagggaaaggggctgggcctcaggaagcagcatcggaggtgcctcagtcatggcatggatccctctcttcctcggcgtccttgcttactgcacaggatttgtggcctcctatgagctgattcagcccaccctcagtgtccgtgtccccaggacaaacagccagcatcacctnctntggagataaatgacgagaataaatatagcttgcctggtatcagacagaagccgaggcccacgtcccctggtggtgtctatctatcaagacaaccgagccggcccgtggggactaccccgngacgcgtattcgtctcgcctccactcgtacggaacacgacgccactctcgacactcgacggacgggacccgagacggcgttgnggtaatgggaaggtcttagttacttttccgaggttccgagggtcgggtaggacgaggaccgacgtaccggtcggtccggtttcgggtcgggacgggacgggaaccaaggtcccgtcggaacccgtcgaccggtcaccggtccgaacgtccgtccccgg

SEQ ID NO: 333880 - DNA, 557 bp, Homo sapiens
  misc_feature: GZ8MTXP02H3QOA.51.60.F05.1.454.CMB.2.raw
  modified_base (201)..(201): a, c, t, g, unknown or other
  misc_feature (201)..(201): n is a, c, g, or t
  modified_base (405)..(405): a, c, t, g, unknown or other
  misc_feature (405)..(405): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgcgagataaatatgctgcctggtatcagcagaacgcaggccagtcccctgtggtgtcatctatcaagcaccaaggccggcccgtcggggactaccccgtgagcgtattctctggcctccacctcgtaggggaaccacgagcccactctcgacccatcaggccgggacgcgaggcnggtgatggagcttgtacttttcgagtcgagggcgtggggacagcgacacgttcggcccggttggttcggggcgggaacggggacccgaaacggtccgtacggtaacccggtcccgtacgggtcccacggaccccgtaacggcccgtccccgg

SEQ ID NO: 333881 - DNA, 633 bp, Homo sapiens
  misc_feature: GZ8MTXP02IDIOI.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagagccaggccagtcccctggtggtggtcatctatcaagacaccaaagccggcccgtcggggatacccctgagcgattctctggctccactctagggaaccacgacgcccactcacgtaccatcgagcggggacgcacgggcgtggtgggatgggacggtcgttacggtactttttaccgtggttacgaacgggggtcggttacgggggacgacggaccgaacgtaaccgttcggggcccgggtttcggggtttacggggacccgggggaaacgggggacccgaaaacgggtccgttaccgggaaccccgggtttccccggtaccggggttaccgaacccgggcccccaaaagggggtccccttcccccccgggg

SEQ ID NO: 333882 - DNA, 534 bp, Homo sapiens
  misc_feature: GZ8MTXP02GJKLZ.51.60.F05.1.454.CMB.2.raw
  modified_base (221)..(221): a, c, t, g, unknown or other
  misc_feature (221)..(221): n is a, c, g, or t
  modified_base (334)..(334): a, c, t, g, unknown or other
  misc_feature (334)..(334): n is a, c, g, or t
  modified_base (387)..(387): a, c, t, g, unknown or other
  misc_feature (387)..(387): n is a, c, g, or t
  modified_base (419)..(419): a, c, t, g, unknown or other
  misc_feature (419)..(419): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctgganataatgcgagataaatatgctgcctggatcagcagaagccaggccagtcccctgtggtggtcatctatcaagacacaagcggaccctcggggataccccgtgagcgattctcnggcctccacctcgtcgggaacacagcccaactcctagaccatcagccgggacncgaggctgtcggagtgaggctgtactttacgngtcgaggcgtggacagcgacgacgtcgtccggtggttccgggacgggtaacggaccgtaacgccgtacggaacccgtcccgtcggtaccgaccgcccgaacggtccctcccccgg

SEQ ID NO: 333883 - DNA, 626 bp, Homo sapiens
  misc_feature: GZ8MTXP02IG7IK.51.60.F05.1.454.CMB.2.raw
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgacgagaataaatatgctgcctggtatcagacagagccgaggcccacgtcccctggttcggtggtcatctatacaagacacgaacgccggcccgtacggggactacccgtgacgcgtattctcgtggcctccactcgtacgggaaccncgacncccactcacgaccatcgacggcggggaccgtcgacgggctggtcggagtggtacggtctttagttaaccgtttttacgtcggttcggacggggtcggtacgggggacacggaccgtaacgtacgtcggaccgggttgggttaccggggaccgggggaacggggaacccaaacgggtccgtccgggtaacccggtcccggttaccgggtccgaacggccccggtaacggtcccgtacccccggg

SEQ ID NO: 333884 - DNA, 582 bp, Homo sapiens
  misc_feature: GZ8MTXP02G6Y0N.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaacgccaggcccagtcccctggtggtggtcatctatcaaacgacaaccgaagccggcccgtcggggataccccgtgacgcgtacttctcgtcggcctccactcgtagggaaccacgacgcccactctacgaccatacgacggcgggaccgcgacggtcgtaggtggaagtcgggaagtcgttagtaccgttttaccgtgttacgacgggtcggtggacgaggaccgacgaccgttcgggccgttggttcgggacgggaacgggaccgaacgccgtacgtaaccggtccgtccggtacgacggacccgaacggccgtccccgg

SEQ ID NO: 333885 - DNA, 591 bp, Homo sapiens
  misc_feature: GZ8MTXP02ID4W8.51.60.F05.1.454.CMB.2.raw
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctatctgganataaattgcgagataaatntgctgcctggtatcagcagaagccaggccagtcccctgtggtgtcatcatacaagacaccaagcggcccctggggataccgtgacgcgacttctcgtcggcctccaccttcgtcgggaaactaccgagccaactctgaccctaancaggccgggacnccgaggtcgnggttggagtggacggtcttaggttaactttttcgtggttaccgaggggcgttgggacacggccgaactccgtgtccgggttggttccgggggcggaaacggggaccgaacggtccgttaaccgcccgggttcccgtcggggtaccacggcccccgaaacggggtcctacccggtcccccccgg

SEQ ID NO: 333886 - DNA, 536 bp, Homo sapiens
  misc_feature: GZ8MTXP02FX9LQ.51.60.F05.1.454.CMB.2.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (437)..(437): a, c, t, g, unknown or other
  misc_feature (437)..(437): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataaatntgctgcctggtatcagcagagcaggccagtcccctgtggtgtcatctatcaagacaccgaagccggcccgtcggggataccccgtgacgcgattctctgggcctccaccgtcgtacggggaaccacgacgcccaactctacgacccatcgaggccgggacgcgaggctggtggagtggaggtctgtacttttacgngttacgagggtcgtgggacagcgactacgtcgtccggttggtcgggacggacgggaccaagcgtacgaaccgtcgtcggtcacgcccgacgccgtcccg

SEQ ID NO: 333887 - DNA, 547 bp, Homo sapiens
  misc_feature: GZ8MTXP02JBL57.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgcgagataaatatgctgcctggtatcagcaagaagccaggccagtcccctgtggtggcatctatcaagaccacgaagccggccctggggactacccgtgacgcgtattctctgggcctccacctcgtacgggaaccacacgcccactctcgaccatccgagcgggaccgcgaggcgtgtggatggaggtcgttgtacttttacgtgttcgagggtcggtgggacaggaccgacgtcgtcggtccggttttcggggcgggtacgggaccgacgccgtcgacccgtccgtcgtccgacgcccgacgccgtaccgtcccccg

SEQ ID NO: 333888 - DNA, 842 bp, Homo sapiens
  misc_feature: GZ8MTXP02F4YVZ.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcgagcagaacgccaggccagtcccctggtggtggtcatctataccaaagaccaaccgaaacggccggccccgtacgggggacttacccccgtaggacgtaccgtactttcctcgttcgggccctcccaaacccgttccgtaaccgggggaaacccaacgacggacccctaaccttccgttacggaacccaacgttacccgaacggggacccgggggtaaaccgccggaacggggtcccgttagggtacgggtaaacgttggggaaacggggttctttacggggttaaccctttttttaaccggtggggtttaaacccggggtacgggggttaccggggttaacgggggtaaaccggaaccgggtacccggtaaacccggtacccgggttaccggggttaccccggggtttacgggggttacccgggggtaaccgggggtaaaacccgggggtaaaccccggtaaaaccggggttccccgggttaacccccggggtaacccccgggtttccccggggttaacccggggtaccccggtaaaccccgggaacccccgggtaaacccggggtcccccggtttacccccgggg

SEQ ID NO: 333889 - DNA, 619 bp, Homo sapiens
  misc_feature: GZ8MTXP02GFPWA.51.60.F05.1.454.CMB.2.raw
  modified_base (200)..(200): a, c, t, g, unknown or other
  misc_feature (200)..(200): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgacgaagaataaatatagctgcctggtatcagcagaagccaggccacgtcccctgtcggtgtcatctatacaagaccacgaacgccggcccgtcggggactaccccgtgacgcgtacttctcgtcggcctccaccttccgtacggggaaccacgaacgccctactcctacgacctacaccgaggcggggaccgacgacggcgttaggtggagttggacggtcgtttgttaccgtttttacgtcggtacgtacgggtccgggtagggacgacggacggtacgaccggtcggtccggttcgggttacggggacgggaacgggaccgaacggtccgtacggtaacccggtcccgtacgggtaccacggaccccgtaacggtcccggtccccgg

SEQ ID NO: 333890 - DNA, 589 bp, Homo sapiens
  misc_feature: GZ8MTXP02GMS26.51.60.F05.1.454.CMB.2.raw
  modified_base (218)..(218): a, c, t, g, unknown or other
  misc_feature (218)..(218): n is a, c, g, or t
  modified_base (497)..(497): a, c, t, g, unknown or other
  misc_feature (497)..(497): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctcnggagataatgacgagataaatatgctgcctggtatcagcaagaacgccaggccagtcccctggtggtgtcatctatacaaacgaccaaccgaacgcccggcccgtacggggactaccccgtagacgcgtattctacgtcgggccctcccaccgttcgtacgggaaaccctacgacgcccaactcctacgacccatcgacggcggacgacgacggtcgtaggtggagtggagtcgttagtaccttttagcgtcgaggtcggacggggacacggccgaacncgtcggtcccggtggtccggggacggacgggaccaaacggtccgtacgaacccggttcgaccggtaccacggacccgaccggtcctccccgg

SEQ ID NO: 333891 - DNA, 671 bp, Homo sapiens
  misc_feature: GZ8MTXP02HAHXU.51.60.F05.1.454.CMB.2.raw
  modified_base (201)..(201): a, c, t, g, unknown or other
  misc_feature (201)..(201): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggattttgtggcctcctatgagctgattcagccaccctcagtgtccgtgtccccaggacaaacngccagcatcacctgctctggagataaatgcgaagataaatatgctgcctggtatcagcagaagccaggccacgtcccctgtggtgtcatctatacaacgacaccgaacgccggcccgtcggggataccccgtgacgcgtattcgtacgtcgggtcctacctaccctccgtacggggaaccacgacgccccaacgttcctacggacccaatccgaacggcggggaacgcgacgggacctggtagggattgggacggtacgttgttaaccgtttttaccggtcggttacgacggggtaccggggttgggggaaccacgggacccggtaacgtacccggttcgggtacccgggtttcgggttaccgggggaccgggggtaaacgggggacccgtaaacggggtccgtacggtaacccccggttccggtcccgggtaccgaccgggaccccgaacgggtcccgttccccccggg

SEQ ID NO: 333892 - DNA, 583 bp, Homo sapiens
  misc_feature: GZ8MTXP02JOZX2.51.60.F05.1.454.CMB.2.raw
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataaattgcgagataatatgctgcctggtatcagcagaagccaggccagcccctggtggtggcatctatcaaagaccaccaaagccggccccgtacgggggactaccccgtgagcgtatttctctcgggcctcccaccttcgtacgggaaccacgacgcccactctacgaccatcacggcggaccgcgaggctgtggatggaggtctggtacttttacgcgtacgagggtcggtagggacaggaccgacgaccgtcggtcccggtgggtttccggggacggggaacgggacccggaacgtccgtaccggaacccgttcccgtcggttaccgacggtaccccggaacggtcccgtcccccgg

SEQ ID NO: 333893 - DNA, 673 bp, Homo sapiens
  misc_feature: GZ8MTXP02I94SD.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataattgacgagataatatgctgcctggtatcagcagaacgccaggccacgtcccctggtggtgtcatctatacgaacgacaccgaaacggcggccccgtcggggactaccccgtgagcgtatttctcgtcggcctcccaccgtctacggggaaccacgacgacccactcgtacgacccagtaccgacgggccggggaccgcggacgggtcgtagggtggagtgggaaggttcttagggttaccctttttacggtcgtaccggtagggggtaccggttagggggaaccacgggtacccgaaacgtaccggttcgggtacccgggttcgggtttaccgggggaccggggtaaacggggtacccgaaaacgggtcccgttaccgggaaccccggtttcccggtccgggttacccgaccggtacccccggaacgggtccccgtttacccccggg

SEQ ID NO: 333894 - DNA, 489 bp, Homo sapiens
  misc_feature: GZ8MTXP02FF3OK.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtccccctgtggtggtcatctatcaagacaccaaagcggcctcggggataccccgtgagcgattctctgggctccacctctgggaacacagccactctgaccatcagcggacgcaggctgtggatgaggctgactttactgtcaggcgtggggacagcgacactgccgtgttcggcggaggaccaagctgaaccgtctcggtcagcccaaggctcccg

SEQ ID NO: 333895 - DNA, 580 bp, Homo sapiens
  misc_feature: GZ8MTXP02HJKXV.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgcgagataaatatgctgcctggtatcagcagaagccaggcccagtcccctggtggtggtcatctatcaaacgacaaccaaggccggaccccgtagggggtactacccccgtgacgtcgtattctcgtcggcctcccacctcgtaggggaaccacgacgcccactctacgaccatcaggcgggacgcgaggctggtacggagtggaggcgttagtacttttacgtacggttcgacgggtcggtagggacacggacgaaccgcgtcggccggttggttccggggacgggacgggaccgaacggccgttacggaacccgttcgacggtccgacgcccgaacggccgttcccccgg

SEQ ID NO: 333896 - DNA, 514 bp, Homo sapiens
  misc_feature: GZ8MTXP02FGSHT.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtcccaaggacaaacagccagcatcacctgctctggagataaattgcgagataaatatgctgcctggtatcagcagaagccaggccagtccccctgtggtggtcatctatcaagacaccaaagcggcctcggggatacccctgagcgattctctggctccacctctgggaacacagccactctgaccatcagcgggacgcaggctgtggatgaggctgacttttactgtcaggcgtgggacaggcgtacacgtcgccggtggttccgggcgggacggggacccaaacggcgtacgaacccgtccgtcggtcacggcccaacggctcccgg

SEQ ID NO: 333897 - DNA, 588 bp, Homo sapiens
  misc_feature: GZ8MTXP02I2QZM.51.60.F05.1.454.CMB.2.raw
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
tcagcgatcgtatacacgaccggtgctcgatttagtacgtcatcagggaaaggggctgggcctcaggaagcagcatcggaggtgcctcagccatgacatggatccctctcttcctcggcgtccttgcttactgcacaggatttgtggcctcctatgagctgattcagccaccctcagtgtccgtgtccccaggacaaacagccagcatcacctgctctggagataattgcgagataatatgctgcctggtatcagcagaacgcacggccagtcccctgtggtggtcatctatcaagaccaccaagccggcccgtcggggactaccccgtgacgcgattcgtcncggcctccncctcgtaggaccacacgccactctgacccatcgaagcggggaccgacgacggtcgtagtggagtggacgggtccgttggttaccctttttagcgttacggacgggtcggtcgggggaaacgcggaccgacgtaccggtcggtccggttagggtccggggacgggtaacgggaccgaacgtccgtaccggtcccgtccggtaccggtaccgaccggtacccgaccggtcccgtcccg

SEQ ID NO: 333898 - DNA, 608 bp, Homo sapiens
  misc_feature: GZ8MTXP02ILWYK.51.60.F05.1.454.CMB.2.raw
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (393)..(393): a, c, t, g, unknown or other
  misc_feature (393)..(393): n is a, c, g, or t
  modified_base (448)..(448): a, c, t, g, unknown or other
  misc_feature (448)..(448): n is a, c, g, or t
  modified_base (478)..(478): a, c, t, g, unknown or other
  misc_feature (478)..(478): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggattttgtggcctcctatgagctgattcagcccaccctcagtgtcccgtgtcccccaggacaaacngccagcatcacctgctctgganataaattgcgaagataaatatgctgcctggtatcagccagaacgccgaggcccacggtccccgtggtggtggtcatctactacaaacgaccaccgacggccggcccgtacggggactaccccgtgacgcgtacttcgtcgtcggcctaccacctacgtggggaaacncgacgcccacttcgacggaccacgtacgaggccggggaccgtcgacggtcgtggnggagtggaggtaccgttgtacttttacggngtccgtagggccggtaggggaccagggaccgtacgacgtcggtccgggttggtcggggaccgggacgggacccaaggcccgtaggcccgtccggtacggtccgaccggtcccgaacggcccgtaccccgg

SEQ ID NO: 333899 - DNA, 673 bp, Homo sapiens
  misc_feature: GZ8MTXP02HUE75.51.60.F05.1.454.CMB.2.raw
  modified_base (176)..(176): a, c, t, g, unknown or other
  misc_feature (176)..(176): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctnagtgtccgtgtccccaggacaaacngccagcatcacctgctctgganataaattgacgagaataaatatgctgcctggtatcagcaagaacgccgaggcccagtccccctgggtggtggtcattctatcaaagaccaccaaggccggtccccgtggggactacccgtgacgtcgatttctcgtggccctccacctcgtacggggaacaccgacgcccctaacgtcctacgaccacgtcgaacgggccgggcgcgaggcctagggtggattgggcggtcttagggtacctttttacgcggttcgaacgggcggggttacgggacgaacggccggaaaccgtacggttccgggtccgggttccggggtttccgggggacggggtaaccgggggaaccccgaaacgggtccccggttcccggggtaaacccccggttcccggttcccggggtaccgtaccccggaccccggaaacggggttccccgttacccccccgggg

SEQ ID NO: 333900 - DNA, 496 bp, Homo sapiens
  misc_feature: GZ8MTXP02FHIGD.51.60.F05.1.454.CMB.2.raw
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcagtctatcaagacaccaaagcggccctcggggataccccgtgacgcgattctctgggctccacctctggggaacacagccactctgaccatcagcggacgcaggcngtgatgaggctgacttttacngtctaggcgtgggacagcgacactgccgtgttacggcggagggccaagctgaaccgtccgtcggtcacgccaacggctcccg

SEQ ID NO: 333901 - DNA, 561 bp, Homo sapiens
  misc_feature: GZ8MTXP02JDTI5.51.60.F05.1.454.CMB.2.raw
  modified_base (332)..(332): a, c, t, g, unknown or other
  misc_feature (332)..(332): n is a, c, g, or t
  modified_base (410)..(410): a, c, t, g, unknown or other
  misc_feature (410)..(410): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaacgccaggcccagtcccctgtggtggtcatctatacaagacaccaagccggcccgtacggggataccccgngacgcgtattctctggcctccaccgtcgtacgggacacgacgcctacgtctcgacccatcaggcggacgcgaggctgnggatcggaggtcttgtacttttacgtagtcgagggtcgtgggacaggccgactacggtcggccggttggtccgggcgggaacggaccgaacgccgtacggaacccgttcccggtacggtacgaccggaccccgaacggtcccgtcccccgg

SEQ ID NO: 333902 - DNA, 582 bp, Homo sapiens
  misc_feature: GZ8MTXP02IDJB9.51.60.F05.1.454.CMB.2.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
tcagcgatcgtatacacgaccggtgctcgatttagtacgtcatcagggaaaggggctggggcctcaggaagcagcatcggaggtgcctcagccatggcatggatcccctctcttcctcggcgtccttgcttactgcacaggatttgtggcctcctatgagctgattcagcccaccctnagtgtccgtgtccccgaggacaaacngccagcatcacctgctctggagataaattgacgagaataaatatgctgcctggtaatcagcagaagccaggcccagtcccctggtggtggcatctatcgaagacaccgaagcccggcccgtaggggactaccccgtgacgcgtattctcgtacgggcctcccacctcgtacgggaaaccacacgcccacctcncgacccatccgagcgggacncgaggcgtgnggagtggagcttgttaccttttacgngtacgagggtacgtgggaactagaccgtaacgtccgtcggtccggttggtacgggaccgggaacgggaccgaacggtctaccggtaacccgtccgttcggacgaccgccccgaaggtccctacccccgg

SEQ ID NO: 333903 - DNA, 593 bp, Homo sapiens
  misc_feature: GZ8MTXP02G241N.51.60.F05.1.454.CMB.2.raw
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (414)..(414): a, c, t, g, unknown or other
  misc_feature (414)..(414): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcacgccaccctcagtgtccgtgtccccaggacaaacngccagcatcactactctgganataatgacgagataaatatgctgcctggtatcagcaagaacgccaacggccagtcccctgtggtcgtcatctatacaagaccaacaacggccggacccgtggggaactaccgtggaacgcgtattctcgtcggcctccaccgttgacggaacacgacgccactcacacacacgacgcggacgcgagcgtggngagtaggtacgacgtacgtttactttacgtggtacgacggtcgggtacggacgacggaccgacgtacgtcgggtccggtcgggtttaccgggaccgggtaacgggaaccgaacgaccgttaccgacccggtaaccgttccggaccgaccggacccgaacgtcccgtaccgtccccccgg

SEQ ID NO: 333904 - DNA, 617 bp, Homo sapiens
  misc_feature: GZ8MTXP02F7G9E.51.60.F05.1.454.CMB.2.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggaccaaacngccagcatcacctgctctgganataatgacgagataatatgctgcctggtatcagcagaacgccgaggcccacgtcccccgtggtcggtggtctatctaatacaaagaccaaccgaaacggcccggacccgtacgggggaactacccccgtggacgtcgtaactttcgtccgtcgggccctacccaccgtcgtacggggaaccacgacgccctacctcgtacgaccatcgagacggggacgcgaggcgtagtggagtggacggtcttcggttacttttacgngtacgngggtacggtagggacgagcgaacgtcgtcggtccggttgggttccggggacgggacgggaccgaacggccgtacggtaacccgtccggtaccggtaccgaccggtacccgaacggcccgtcccccgg

SEQ ID NO: 333905 - DNA, 530 bp, Homo sapiens
  misc_feature: GZ8MTXP02FXY1M.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataatgcgagataatatgctgcctggtatcagcagaagccaggccagtcccctgtggtggtcatctatcaagacaccaaagccgcctcggggataccctgagcgattctctggctccacctcgtacgggacacacgccactctcgaccatcaggcggacgtcgaggctggtgatggagctgtactttacgtgtcgaggcgtgggacaggcgacacgtcggccggttggttccggggcgggaacgggaccgaacggcgttacggaacccgtccgtcggtaccacggaccccaacgggccttcccccggg

SEQ ID NO: 333906 - DNA, 552 bp, Homo sapiens
  misc_feature: GZ8MTXP02IB7Z5.51.60.F05.1.454.CMB.2.raw
  modified_base (175)..(175): a, c, t, g, unknown or other
  misc_feature (175)..(175): n is a, c, g, or t
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (379)..(379): a, c, t, g, unknown or other
  misc_feature (379)..(379): n is a, c, g, or t
  modified_base (462)..(462): a, c, t, g, unknown or other
  misc_feature (462)..(462): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctnagtgtccgtgtccccaggacaaacagccagcatcacctgctctggagataaattgacgagaataaatatgctgcctggtatcagcagagcagccagtcccctgtgngtcatctancaagacacagccggcccgtggggataccctggagcgattctcgtcggcctccactcgtacgggaaccacacgacccacctcacgaccancgagcgggacgcgagcgtgtggattggacgggcttagtaacttttcgtggttcgaacgggtcggtagggaccgagacgtaacnccgtgccggttggtaccgggcgggacggaccgaacggttccgaacgcccgtcccgtcggaccgaaccggcccgaacggtccgtcccccgg

SEQ ID NO: 333907 - DNA, 740 bp, Homo sapiens
  misc_feature: GZ8MTXP02H0240.51.60.F05.1.454.CMB.2.raw
  modified_base (200)..(200): a, c, t, g, unknown or other
  misc_feature (200)..(200): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaatgcgaagataaatatgctgcctggtatcagcagagccaggccagtcccctgtggtggtcatctatacaaagacaaccgaaaggccggaccccgtcgggggactacccccgtaggacggtccggaactttccgtccgttcgggcccgttcccgtaaccccttcccgtacggggggaaaccaaccgacggaccccctaaaccttccctacggaaccctacgtccgaacggccgggggaaccgcggaacgggccgttaggtaggaagtgggaacgggtcgttgggttaaacctttttacgtaggttacccggtagggtaccgggttcgggggaaccgttaacgggacccgacgtaaacccggttccggggtacccgggtttacggggttcccgggggacgggggtaaaccggggtaaccggaacggtaccgttaccggggtaaccccggtccccggtttaccgggtacccggtaaccggacccccggtaaacggggtccccgtttaccccccgggg

SEQ ID NO: 333908 - DNA, 566 bp, Homo sapiens
  misc_feature: GZ8MTXP02JATXN.51.60.F05.1.454.CMB.2.raw
  modified_base (200)..(200): a, c, t, g, unknown or other
  misc_feature (200)..(200): n is a, c, g, or t
  modified_base (478)..(478): a, c, t, g, unknown or other
  misc_feature (478)..(478): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataaattgcgagataatatgctgcctggtatcagcagaagccaggccagtcccctgtggtggtcatctatcaagacaccaacgcggccctcggggactaccccgtgacgcgactttcgtcgtcgggcctccacccgtcgtacggggaaccacgacgcccaactctacgaccaatcaggacggaccgcgaggccgtggtggagtggaggtccttaggtacccttttagcgtaccgagggcggtagggacaggcgacncgtcggccggttggtccgggacggacggggaccaacggtcgtacgaacccgttccgtacggtcaccggcccaacgggccttccccggg

SEQ ID NO: 333909 - DNA, 616 bp, Homo sapiens
  misc_feature: GZ8MTXP02HVCBL.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtcgtccgtgtccccaggacaaacagccagcatcacctgctctgagataatgacgagataaatatgctgcctggtatcagcagaacgccaggccacgtcccctggtggtggtcatctatcaagacacaagccgaccgtcggggactaccccgtgacgcgattctcgtggcctcctactcgtacgggaaacaccgacgacccactcacgtaaccactacgacggcgggaccgcgacggcgtgggtaggtaagtgggacggtcgtttaggttaactttttacggcggtttacggacggggtacgggttagggacgacgaccggtacaacggttcggtccgggttcggggttaccgggccggggaacgggaacccgaacggtccgttaccggaacccggtccgtccggtaccgaacgacccccggtaacgtcccgtcccccgg

SEQ ID NO: 333910 - DNA, 573 bp, Homo sapiens
  misc_feature: GZ8MTXP02I6KCI.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgcganataatatgctgcctggtatcagcagaagccaaggccagtcccctggtggtggtcatctatacaaagacaaccgaaagccggaccctacggggacttaccccgngaacgcgtaactttctcgtcggccttacccaccgtcgtacgggaacacacgacccaacttcacgaccagtcaggacgggaccngaggccgttaggngagtagagtacgtagttacgtttacgttacgtacgtacggtacggtacggacgacgacgacgacgtcggtcggtcggtacgggacgggacggacgacgacgtacgtaaccgtccgtacgtacgacgaccgacgaccgtccg

SEQ ID NO: 333911 - DNA, 743 bp, Homo sapiens
  misc_feature: GZ8MTXP02J2KTQ.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (396)..(396): a, c, t, g, unknown or other
  misc_feature (396)..(396): n is a, c, g, or t
tcagcgatcgtatacacgaccggtgctcgatttagtacgtcatcagggaaggggctgggcctcaggaagcagcatcggaggtgcctcagccatggcatggatccctctcttcctcggcgtccttgcttactgcacaggatttgtggcctcctatgagctgattcagccaccctcagtcgtccgtgtccccaggacaaacngccagcatcacctgctctgganataatgacgagataaatntgctgcctggtatcgagcaagacgccaggcctacggtcccctgtggtcgtcatctaatcaaagacaccgaacggcccggacccgtggggactacccccgtgacgccgtacttccgtcgtacgggtccctacccgtaccgttacgacggggaaaccncgtaacgcccaaacttcccgacggacccctagtacccggagggacccgggggaacttccggaagggtccgttagggttcggggaacgtttaggggaccggttcgttacgtttaaccgtttttacccggggtacggtaccggacgggggttaccggtaacggggtaaccgtaccgggtacccgtaaccgttaccggttcccggggtacccggggttacggggtacccgggggaaccgggtaaccgggaacccgttaccggtacccgggttaacccggtaaccccggttacccggtaccgggtaacccgtaacccggacccccggtaaccgggtcccccgtacccccgg

SEQ ID NO: 333912 - DNA, 663 bp, Homo sapiens
  misc_feature: GZ8MTXP02IAVU3.51.60.F05.1.454.CMB.2.raw
  modified_base (233)..(233): a, c, t, g, unknown or other
  misc_feature (233)..(233): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaatgacganaataaatatgctgcctggtatcagcagaacgccaggccacgtccccgtggtggtggtcatctaatacaaagacaccgaaagccggacccgtacggggactaccccgtggacgcgtatttcgtcgttcgggcctacctaccgtccgtacggggaaaccaccggacacccaccttccacggaaccctacgtaccgacgggaccggggaacgcgaacggggtccgtgggtaggaacgtggaacggtcgtttagtttaccgtttttacggcgttacggacgggacgggttaggggacgtacggccggaactaccgtcgggccgggtttgggtaccgggtacggggaaccggggtaccgaacggtccggtaaccggtcccggttccggttaccggtacggaacccggacccggaacgggtcccgtacccccgggg

SEQ ID NO: 333913 - DNA, 612 bp, Homo sapiens
  misc_feature: GZ8MTXP02GT5VO.51.60.F05.1.454.CMB.2.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (346)..(346): a, c, t, g, unknown or other
  misc_feature (346)..(346): n is a, c, g, or t
  modified_base (406)..(406): a, c, t, g, unknown or other
  misc_feature (406)..(406): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctgganataatgcganaataatatgctgcctggtatcagcagaacgccgacggccctacggtcccccgtggttgggtgtctagtctaatcaaacgaccaaccgaaggccggcccgtcggggactacccgngacgcgtattcgtcgtcggcctccaccgtcgtagggaacacacgccactctacgacctanccgagaccgggacgcgaggcgtggaggtagtggaaggtctttagttaccttttacggtcggtcgaacgggtcgggtacggaacgacgggccgaaaccgccggttacgggtcccgggttcgggttccggggacggggacgggaccgaaccggtctccggtaaccggtccgttccggaccgaccgtcccggaacggtcctacccccgg

SEQ ID NO: 333914 - DNA, 521 bp, Homo sapiens
  misc_feature: GZ8MTXP02IE74Q.51.60.F05.1.454.CMB.2.raw
  modified_base (201)..(201): a, c, t, g, unknown or other
  misc_feature (201)..(201): n is a, c, g, or t
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaatgcgagaataaatatgctgcctggtatcagcagaagccaggccacgtcccctgtggtggtcatctatcaagacaccaacgcggccctcggggactaccctgagcgattctcgtgcctccacctcgtcgggaacacgagccactcncgacatcgagcggacgcaggctgtgatgagctgtactttacngtcaggcgtggacgngacgagaccgtcggccgtggttcggacggggacggaccgaacggctcggaaccgtccgttaccggacgacgcccgaacggccgtaccccgg

SEQ ID NO: 333915 - DNA, 606 bp, Homo sapiens
  misc_feature: GZ8MTXP02IR0G9.51.60.F05.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
tcagcgatcgtatacacgaccggtgctcgatttagtacgtcatcagggaaagtggctgggcctcaggaagcagcatcggaggtgcctcagccatggcatggatccctctcttcctcggcgtccttgcttactgcacaggatttgtggcctcctatgagctgattcacgccaccctcagtgtccgtgtccccaggacaaacagccagcatcacctgctctgganataaattgacgagataaanatgctgctggtatcagacagaanccaggccacgtccctggtgtggcatcatcaaagacaccgaacgccggcccgtaggggactaccgtgagcgtatttccgcgtcggtacctcccgaccttacgaccgggaaacacgaccgaccctactacctacgaacccagtaccgacggacgggggacccgacggacgggtcgtagggtaggtagtaggacggttcttacggtttacctttacggcgttacggacggggtcggtacgggtaacgacggccgaccgtcgtcggtccggtcggtacggggacgggacggaccgaggtccgtaacggtaccgtccgtccggaccgaccggtaccgacggtcccg

SEQ ID NO: 333916 - DNA, 622 bp, Homo sapiens
  misc_feature: GZ8MTXP02IW7AL.51.60.F05.1.454.CMB.2.raw
  modified_base (201)..(201): a, c, t, g, unknown or other
  misc_feature (201)..(201): n is a, c, g, or t
  modified_base (483)..(483): a, c, t, g, unknown or other
  misc_feature (483)..(483): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagtataaatgcgaagaataaatatgcttgcctggtatcagcaagaacgccaggccacgtcccctgtggtggtcatctatacaagaccaccgaacggccggccccgtacggggactacccgtgacgcgtacttcgtcgtcggcctccctacccgtcgtacgggaaccacgacgccactcgtacgaccatcgaggcgggacgcgaggctgtggagtggacggtcttggtaccttttagtcgtacgacgggtcggtacgggaacncggacgacgtacggtcgggtcccggttgggttaccggggacggggaacggggtaccgtaaacggcccggttacggtaaccccggtcccggtacgggtaccgaacccggtaccccgaacgggtccccgtttacccccggg

SEQ ID NO: 333917 - DNA, 625 bp, Homo sapiens
  misc_feature: GZ8MTXP02I0296.51.60.F05.1.454.CMB.2.raw
  modified_base (395)..(395): a, c, t, g, unknown or other
  misc_feature (395)..(395): n is a, c, g, or t
  modified_base (493)..(493): a, c, t, g, unknown or other
  misc_feature (493)..(493): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataattgcgagataatatgctgctgtatcagcagaacgcacggccagtcccctgtggtggtcatctatcaagacacacgcgacccgtcggggatacccgtgacgcgtactttcctcgtcggtcctcccgacccttcggtacgggaaccacgacgcccactcgtacgacctacncgacgggcgggacgcgacggtctgggtggaagtcggaacggtcttacggttaccgtttttacgcggttaccggacggggtcggttacggggaaaccgngggtaccgtaaccgtaacggttccgggtaccggtttcggggttccggggaccggggaacggggttaccgaaacggtccgttaccggaaccgtttccgacggtaccgaccgacccgacggtcccgtcccccgg

SEQ ID NO: 333918 - DNA, 602 bp, Homo sapiens
  misc_feature: GZ8MTXP02GMI0T.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (337)..(337): a, c, t, g, unknown or other
  misc_feature (337)..(337): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtcgtccgtgtccccaggacaaacngccagcatcacctgctctgganataaatgcgagaataatatgctgcctggtatcagcagaacgccaggccacgtcccctggtggtgtcatctatacaaagaccaaccgaagccggcccgtacggggactaccccgngacgtctacttctcgtcggcctccgacctcggtacggaaccacgacgcccactctacgaccagtcgacgggcggacgcgacggtcgtaggtaggagttgggacggtcttacgttaccgtttttacggtcggtaccggtaggggcggtaggggaacacggccgaacgtcggtcggtccgggttggtccgggggacgggacgggaccgaacggtccgtacggtaacccgtccgacggtccgaccgcccggtaacggcccgtccccgg

SEQ ID NO: 333919 - DNA, 563 bp, Homo sapiens
  misc_feature: GZ8MTXP02G4G43.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (407)..(407): a, c, t, g, unknown or other
  misc_feature (407)..(407): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtcgtccgtgtccccaggacaaacngccagcatcacctgctctgganataatgcgagataatangctgcctggtatcagcagaacgccgaggccagtcccctggtcggtggcatctatacaagaccacaacggccggcccgtacggggactaccccgtgacgcgtattcgtctcggcctccacctcgtacgggaaccacgacgcccactctacgaccatcgacgcgggacncgacggctggtggaatggagtcgttagtactttcgtgtcgaggtcgggtaggggacaggaccgacgtacgtcggtccggtggttcgggacgggacgggaccaaggccgtcggtaacccgtcgtacggacgaccgcccggaacggtccgtaccccgg

SEQ ID NO: 333920 - DNA, 667 bp, Homo sapiens
  misc_feature: GZ8MTXP02JHOSF.51.60.F05.1.454.CMB.2.raw
  modified_base (175)..(175): a, c, t, g, unknown or other
  misc_feature (175)..(175): n is a, c, g, or t
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctnagtcgtccgtcgtccccaggacaaacngccagcatcacctgctntggatataatgcagataatntgctgtcctggtatcgagcagaacgccgaggaccctacgtccccgtggtcggttcggactagtactactacaaacgaccaaccgaacggcccgggcccgtacggggaactaccccgtagacgtaccgtactttccgtacgtcggtcctaccccgaccgttaccgacggggaaccacgacgacccctactactaccgacctagtaccgagggaccggaccgcgaggtcgtgtggacgtaggacgtcgttacgttacgttttacgcgttacggcgggtacgggtacgggacgaccggtacgaccgacgtccggttccgggttacgggttaccggggacggggaaccggtaaccgacgggttccggtaaaccggtccccggtccgtaacccggttaccgaacggtacccccgaacggtccccgtcccccgg

SEQ ID NO: 333921 - DNA, 524 bp, Homo sapiens
  misc_feature: GZ8MTXP02F1F11.51.60.F05.1.454.CMB.2.raw
  modified_base (200)..(200): a, c, t, g, unknown or other
  misc_feature (200)..(200): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctggagataattgcgagataaatatgctgcctggtatcagcagaagccaggccagtcccctgtggtggtcagtctatcaagacaccgaagccgcccgtcggggactaccccgtgacgcgacttcgtctcggcctcccaaccttcgacgggaacacgacgccactctcgacctancgaagcggacncgaggctggngngngngtcgtgtattacgtgtcgcggcggtcggacgacgacgacgacgtcgtcggtcggtcggacggacggacgacgcgtacgccgtccgtcgcgacgaccgacgccgtccg

SEQ ID NO: 333922 - DNA, 651 bp, Homo sapiens
  misc_feature: GZ8MTXP02ILLB8.51.60.F05.1.454.CMB.2.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagccacctnagtcgtccgtgtcccaggacaaacngccagcatcactgctcgtggagtataaatgacgaagaataaatatgctgccgtggtatcgagacaagacgccacggccacgtcccctggtggtcggtcatctanacaagaccaaccgaacgccggtacccgtacggggactacccgtgacgcgtacttctcgcggtcctcctacctcgtacgggaaccacgacgacccactcacgacactcgaggccggacggacgacggtcgtggacggtagtacgggacggtcgtttaggtttaccgtttttacgtacgggttaccgtagggggtcggttacggggactaacggggccgtaacgtacggttcgggtcccgggttggggttaccggggaccggggaacggggtaccgaccggtacgtaccggtaacccgttccggtaccgggaccgtaacggtaccccggaacggtacccgtcccccggg

SEQ ID NO: 333923 - DNA, 660 bp, Homo sapiens
  misc_feature: GZ8MTXP02IVJED.51.60.F05.1.454.CMB.2.raw
  modified_base (223)..(223): a, c, t, g, unknown or other
  misc_feature (223)..(223): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacagccagcatcacctgctctgganataatgacgagataatatgctgcctggtatcagcagagccaggccagtcccctgtggtggtcatctatcaagacacaacgccggcccgtggggactaccccgngacgcgattcnctggcctccacctcgtacgggaaccacgacgcccactcctacgaccactccgaaggcggggaccgcgaacgggtcctagggtaggagtaggacgggtctttaggttaaccctttttacggtacggtaccggtacggggtacgggttacgggggaacctaacgggaccgtaacgtacccggttacggggtcccgggtttacggggtttcccgggggaaccgggggttaaccgggggaacccgaaaacggtcccgtacgggtaaccccggttcccggttaccgggtaccgaccggtaccccggaaacggggtcccttcccccggg

SEQ ID NO: 333924 - DNA, 571 bp, Homo sapiens
  misc_feature: GZ8MTXP02F2E9S.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataaatgcgagataaatatgctgctgtatcagcagagccaggccagtcccctgtggtgtcatctatacaaagacaccaaggccggacccgtggggaactaccccgtgacgcgtacttcgtcttcgggcctcccaaccgttaccgtaggggaaaccacgaaacggccctaaactcctacgacccaatcgacgacgggacgccgaggcgtgtggaagtgaggcgtgttacgtttaaccgttgtccgtagggcggtgggacggacgacgacgtacgtcgccggtcggttcgggacgggacgggaccgaacgacgtcgaaccgtccgtcggtcgacggaccgaacgcgtcccg

SEQ ID NO: 333925 - DNA, 678 bp, Homo sapiens
  misc_feature: GZ8MTXP02H2K8U.51.60.F05.1.454.CMB.2.raw
  modified_base (176)..(176): a, c, t, g, unknown or other
  misc_feature (176)..(176): n is a, c, g, or t
  modified_base (201)..(201): a, c, t, g, unknown or other
  misc_feature (201)..(201): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagcccacctnagtgtccgtgtccccaggacaaacngccagcatcacctgctcgtggagtaataaagttgacgaagtaataaatatagctgcctggtatcagacaagaacgccgacggccgacgtcccccgtggtcggtcggtactactactactacgaaaacgacaaccgaacggccggaccccggtacggggactaccccgtagaaacgtacttacctgtcggtcctccctaccgtcgtacgggaaaccacgacgacctaactcctacgaccatcgacggaccgggacgcgacggtcgtgggtggtagtacggacggttacgttacggtttaaccttttaacgtcggttaccggaacgggtcgggtacgggaacgagggtaccgacgtacgtccgggtaccgttcggggttaccggggacggaaccggggaaccgtaacggtccgtaaccggtcccgttaaccggtccggtacgaccggtacccgaacggtcccgtacccggtccccccgg

SEQ ID NO: 333926 - DNA, 626 bp, Homo sapiens
  misc_feature: GZ8MTXP02IS9C7.51.60.F05.1.454.CMB.2.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (469)..(469): a, c, t, g, unknown or other
  misc_feature (469)..(469): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtcgtccgtcgtccccaggacaaacgngccagcactcacctgctcgtgatataattgacganataaatatgctgcctggtactcgagacaagaacgccacggccctacgttccccgtggttcgggtggtactattactactacaaacggacctaaccgaacggccggtcccgtacggggtacttaccccgtggacgtacgtactttcgtaccgttcggcctacccgtaccgtcggtaacggaaccacacggcccacttcgacgaccactacgacggcggacgacgtggcgtgnggtagtaggacggtacgttgtttaccttttgacggtacggacgggtcggtaggaacgcgacgaacgcgttcggcggttagggtccgggacggggaacgcgaacgtccgtacgtaacccgtcgtacggtaccgaccggtaccgtacggccgtccccgg

SEQ ID NO: 333927 - DNA, 583 bp, Homo sapiens
  misc_feature: GZ8MTXP02F7MZM.51.60.F05.1.454.CMB.2.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtcgtccgtgtccccaggacaaacacgccagcatcacctgctcgtgagataattgcgagataatatgctgctgatcagcanacgccaggccacgtccctggtggtcggtcatactatacgaanacaccgaacgccggtccgtacgggactaccccgtggacgtcgtacttcctcgtcggtccctaccctaccgtcgtaacgggaaccacgacgtacccactctcgaccagtaccgagggaccgggacgccgaggtcgtaggtggacgtggaggtaccttgttaccgttttcgnggtaccgtagggcggtaggaacncggcgactgtcggtcggttacggtccgggacgggtaccggacgtaacgcgtcggaacccgtcgtcggaccacggaccgacgtcctccccgg

SEQ ID NO: 333928 - DNA, 626 bp, Homo sapiens
  misc_feature: GZ8MTXP02H7IH7.51.60.F05.1.454.CMB.2.raw
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (291)..(291): a, c, t, g, unknown or other
  misc_feature (291)..(291): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtcgtccccgaggacaaacagccagcatcacctgctntgganataatgcganataatatgctgctgtatcagcagacgcacgccacgtcccctgtggtgtcatctanacaacgacaaccgacggcccggacccggtcggggactccccgtagacgtcgtattccgtcgtcggtcctccctacccgtcggtacgggaaacctacaccgcctaaccttcncgaaccactcgagaccggggacnccggaggtcgtggnggagtgacggtcgttcggttacttttacgtcggtacgtggggtacgggtacggggaacgacggtaccgaaccgtcgtcggtaccggggttgggttccgggggacgggaaccggggaccgtaacggccgtaccgtcccggttcccgtacggtacccgaccggacccgaaccgggtcccgtcccccggg

SEQ ID NO: 333929 - DNA, 500 bp, Homo sapiens
  misc_feature: GZ8MTXP02HLGM1.51.60.F05.1.454.CMB.2.raw
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (414)..(414): a, c, t, g, unknown or other
  misc_feature (414)..(414): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagcaggccagtcccctgtgtggtcatctatcaaagacacaagcgcctcgggganacccctgagcgattcnctgctccactctgggaacacagtcccatcnaccatcagcgggacgcaggctggngagtgagctgtactttactgtcgaggcgnggacgagacgacacgtcgtcgtcggtcggacgggacggaacgacgtacgcgaaccgtaccgtccggtcgacgaccgacgacgtccg

SEQ ID NO: 333930 - DNA, 801 bp, Homo sapiens
  misc_feature: GZ8MTXP02IC03K.51.60.F05.1.454.CMB.2.raw
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtcgtccgtcgtccccaggacaaacngccagcatcactgctntgganataaattgcgataataatangctgcctggtatccagacagaacgccacggccacggtccccgtggttgggtgtacattctaatacgaaacgaccaaccgaacggcccgggtaccccgtacgggggtaactaccccgtggaacggtcgttacttccgtacgttcgggcccttcccgtacgtaccgggtacggggaaacccacgacgtaccctaaccgttcgtaccggaacccttacgtaaccggaagggggtaaccgggggtaccgaaccgggtaacgggtcccgggtttaggggtacgggtaaggttaaccgggggtaacgggtttacccggttttaacgggtttttaaccccgttttttttaacgggccggggtttaccccgggaaaggggttcccgggggttacggggtaaacccgtcgggtaacccggacccgttaaccggttcggggttaccccggggtttacgggttaccgggggaaaccggggtacggggaacccgtaacggtcccggtaccggtaaccccggttcggttaccggaccggaccggaccccggtacggtccccgtcccccggg

SEQ ID NO: 333931 - DNA, 584 bp, Homo sapiens
  misc_feature: GZ8MTXP02G3ZU8.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (487)..(487): a, c, t, g, unknown or other
  misc_feature (487)..(487): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcacctgctctgganataattgcagataatatgctgcctggtatcagcagaacgccaggcccacgtcccctgtcggtggtcatctatacaacgacaccgaacgccggcccgtcggggtactaccccgtgagtcgtattcgtcgcgcctccactcgtacgggaaccacgacgacctactcgtacgaccacgtcgacggacgggaccgcgaagggtccgtaggtggtaagtggaacggtccgttagttacgttttacgtggtaccgaggtcgggtaggacgngaccgacgcgtcggtccggttggttcggggacgggtacggaaccgacgtccgtacggaacccgtcgtaccggacacggacccgaacggcctccccgg

SEQ ID NO: 333932 - DNA, 720 bp, Homo sapiens
  misc_feature: GZ8MTXP02IVI19.51.60.F05.1.454.CMB.2.raw
  modified_base (176)..(176): a, c, t, g, unknown or other
  misc_feature (176)..(176): n is a, c, g, or t
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (329)..(329): a, c, t, g, unknown or other
  misc_feature (329)..(329): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgctttactgcacaggatttgtggcctcctatgagctgattcagcccacctnagtgtccgtgtccccaggacaaacngccagcatcactgctctgganataatgacgagaataatatgctgcctggtatcagnagaagccaggcccacgtccctggtgtggtcatctancaaagaccacacggaccggccgtaggggactacccngacgcgtacttcgtcgtcggccctccaccgtcgtaacgggaaccacgacgaccctactcacgtaccacgtcgaacgggaccgggacgccgagggtccgtaggtaggtagtagggtacgggtacctttagggttaacccctttttagggtaccggtacggtaaacgggggttcccggggttacggggaaaaccggttaccgggacccggtaaaaccggtccggtttacccgggggtcccgtttacggggggttacccgggggaaaccgggggttaaaccggggaaccccgtaaaacgggtcccggtaccccgggtaaacccggtttcccggtaccggttaccccggaaaacccggtcccccgggtaaacggggttccccttaccccccgggg

SEQ ID NO: 333933 - DNA, 671 bp, Homo sapiens
  misc_feature: GZ8MTXP02HRV9G.51.60.F05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcagccacctcagtgtccgtgtccccaggaacaaacngccagcatcacctgctctgganataaatcgaggaanaataaatangcgtgcgtaggtacncgagacagacgaccgacggccgacgtcccgtggtggtgtacatactaactacgaaacgaccgaaccgaacggcccggacccgtaggggtaactaccccgtagacgtacgtacttcgtcgtcggtccctaccgaccgtcgtacggaaccacgaccacccactacctacgaccacgtacgacgacgggtacgacgtaggtcgtggtacggtagtacggtacggttcgttacgtttacgtttacgtacgtacggtacgggtacgggtacgggtaacggtacggacggaccgtaccgtaccggtccggtcggggtacgggtaccggggtaacgggaccggtaccggtaccggtaccggtaacccgtcccggtaccggtaccggtacccggacccggtacccggtaccgtacccg

SEQ ID NO: 333934 - DNA, 630 bp, Homo sapiens
  misc_feature: GZ8MTXP02JC97C.51.60.F05.1.454.CMB.2.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (427)..(427): a, c, t, g, unknown or other
  misc_feature (427)..(427): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggacaaacngccagcatcacctgctcgtgganattaattgacgagaataatatgctgctggtatcagcaagacgccaggccacgtccccgtggtggtgtcatctatacaaagaccaccgtaacgcccggtcccgtacggggactaccccgtggacgtcgtattcctcgcggtcctaccgacctcggtaccgggaaccacgacgccctactctacgaccatcgaagggccggacncgacgtcgtagaggagttcggagtcgttacgttaacctttttggcgtaccggaggtacggtcggggaaccgcggacgtaccgtacggtcggtccggttacgggtaccgggaccgggtaaccggtaccgaacggtcccggtaccggtaacccggttcccggtaccggtacccggacccggaccggtaccggtccccgtccccgg

SEQ ID NO: 333935 - DNA, 622 bp, Homo sapiens
  misc_feature: GZ8MTXP02GE5N8.51.60.F05.1.454.CMB.2.raw
  modified_base (201)..(201): a, c, t, g, unknown or other
  misc_feature (201)..(201): n is a, c, g, or t
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcactgctctggagtataattgacgaagaataaatatgtctgtcctggtaatccgagacaagaacgccgaaggcctacgtcccctggtggtcggtcatctataccgaaanacgaaccaaacggtccggacccgtacggggactacccgngacgcgatttccncgtcgtcctaccactcggacgaacacncgacctactcacactacgacgaggaccggacgcgtagtcgtagtgtagtaggtaggtacgttacgtttacgtttacgttacgtacggtacgggtacgggtacgggacgacgacgtacgtacgtacggtcggttcgggtcgggtacggggaacggtaccgaacggtaccgtaccgtaaccggtaccggtaccggtaccgtaccggacccgaccggtaccggtcccg

SEQ ID NO: 333936 - DNA, 727 bp, Homo sapiens
  misc_feature: GZ8MTXP02GI32E.51.60.F05.1.454.CMB.2.raw
  modified_base (227)..(227): a, c, t, g, unknown or other
  misc_feature (227)..(227): n is a, c, g, or t
  modified_base (433)..(433): a, c, t, g, unknown or other
  misc_feature (433)..(433): n is a, c, g, or t
tcagcgatcgtatacacgaccggtgctcgatttagtacgtcatcagggaaaggggctgggcctcaggaagcagcatcggaggtgcctcagccatggcatggatcccctctcttcctcggcgtccttgcttactgcacaggattttggtggcctcctatgagctgattcagcccaccctcagtgtccgtgtccccaggacaaacagccagcatcacctgctcgtgganataaattgcgagataaatatgctgcctggtatcagcagaagccaggccagtcccctggtggtggtcatctatcaaagacaccgaaacggccggcccgtacgggggaataccccgtaggacgtcgtagttcctcgtgggcctcccgacctcgtacgggaaccacgacgcccactcctacgaccctacgtacgaacggccggggaccncggaaggtaccgtagtagggaaagttccgggaaaggggtcttacgggttaacctttttaccggtaggtttacccgaaaggggtcgggttacggggaaacccgtaaggtcccggaaaaccgtaaccggttaccggggtaccccggggtttcggggtttaccgggggaccggggtaaacgggggtacccgaaaaccgggtccgttaaacccggggtaacccccggttttcccggggaacccggttaccggaacccgggacccccggtttaaaacgggccccggtttaccccccggg

SEQ ID NO: 333937 - DNA, 616 bp, Homo sapiens
  misc_feature: GZ8MTXP02HX2RN.51.60.F05.1.454.CMB.2.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (357)..(357): a, c, t, g, unknown or other
  misc_feature (357)..(357): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtcgtccgtgtccccaggaccaaacngccagcactcacctgctctgganataattgacgagaataatntgctgcctggtactcagacagacgccaggccacgtccccgtggtggtgtctagtctatacaaacgacaaccgacggccggtcccgaggggactacccgagagacgtacttcncgtacggtccctacctaccgtccggtacggaacccacgaccgtacccacttccgacgtacccagtaccgacgggaccgggaccgacggacgggcttgggaggtaagtcgggaacgttcgttagtttaccttttaggccgtacggacggtcggtagggacacggaccgaactccggttcggccggtttagggtccgggacgggacggtacgacgtcgccgaacccgtcgtacggcgaccgacccgtaggtcccgccccgg

SEQ ID NO: 333938 - DNA, 582 bp, Homo sapiens
  misc_feature: GZ8MTXP02F7L2K.51.60.F05.1.454.CMB.2.raw
  modified_base (406)..(406): a, c, t, g, unknown or other
  misc_feature (406)..(406): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggaccaaacagccaggcatcacctgctctggagaataaattgcgagaataaatatgctgctggtatcagcagaagccaggccacgtcccctggtggtgtcagtctaagtcaaacgacgaacccaaaggcccggacccggtacggggaacttaccccgacggacgcgtacttcttcgcgggtccctccgaaccgttccgaggggaaccaacgacnccctaactctaccaaccagcgacggacgggcacgtcggtgtagggcgtagtaggtagtcgtcgttacgtttacgtacgtcgaggtacggtacggacgacgacgacgcgtcgtcggtcggtcggcggacggacgacgtcgtcgtccgtccgtacggtacgaccgaccgacgcgtccg

SEQ ID NO: 333939 - DNA, 677 bp, Homo sapiens
  misc_feature: GZ8MTXP02H86TM.51.60.F05.1.454.CMB.2.raw
  modified_base (576)..(576): a, c, t, g, unknown or other
  misc_feature (576)..(576): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtatttgtggcctcctatgagctgattcacgccaccctcagtcgtccgtcgtccccaaggaacaaacagaccagacataccacctactctaggaagtaataagttgacgaagtaaataaatatgactcggtaccgtaggtaactacgaacgacgaagaaacgcccgaacggaccccgtaacggtcccccgtggttcgggtcggtactaagttctaagtaaccaaacggaaccctaaccgaacggcccggtacccggtacggggtaaacttaccgacgacgtacgtactttccgtcgtccggtccctcccgtacccgtcggtaaaccgggaaccaaccgaccaccctacgtaccacgaacacaccggacgggaccgaacgccgtaagcgtagggtagacgaggtcgtacgttacgtttaccgtttagtcgaggtacggnggacgacgacgcgtaacgcgtcggtccggtagccgggacgacggaacacgtcaccgtccgttaaccgcgaccgacgaacccgcggtccctacccgccccgg

SEQ ID NO: 333940 - DNA, 641 bp, Homo sapiens
  misc_feature: GZ8MTXP02JE9NZ.51.60.F05.1.454.CMB.2.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngccagcatcactgctcnganataatgngagataatangctgcctggtatcagcagaagccaggccacgtcccctggtggtcggtcacgtctaatacgaaaacgaccaaccgaacggcccggaccccgtacggggactaccccgtggacgcgtacttcgcgtcggcctcctactcggtacggaacacgacgcccaactcgtacgacccagtaccgagggaccggaccgacgacgggtcgtaggtggaagtggaaggggtcttaggtttaaccttttacggtcgtacggtacggggtacggtacggggacacggtaccgacgtaccgtcgggtccggttcgggttaccggggacgggttaaccggaccgaaacggtcccggtacggaaccccggttcgtacccggggtacaacccggaccccgaacgggtcccttcccccggg

SEQ ID NO: 333941 - DNA, 677 bp, Homo sapiens
  misc_feature: GZ8MTXP02IVTUJ.51.60.F05.1.454.CMB.2.raw
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (313)..(313): a, c, t, g, unknown or other
  misc_feature (313)..(313): n is a, c, g, or t
  modified_base (348)..(348): a, c, t, g, unknown or other
  misc_feature (348)..(348): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggattttgtggcctcctatgagctgattcagcccaccctcagtcgtccgtcgtaccccgaggaacaaacngccagcactcacctgctcgngganataatgaganaataatntgctcgcgtgtactcgagacgagaaccgcgaacggcccaccgttaccctggtcgtgtcatactanacaacgacacgaccgccggccgtagggactaccgngacgtctacgttctcgtcggcctccgaccttacggacgaccacaccgcctactctaccgacaacgcgaacgggcggtcgacggtaggtccgttagggacgtaagtcggtaacggttccgtttacgtttaccgtttacggcggtacccggtagggtccgggtagggacgaacggccgaacgtcggttccgggtaccgggtttaccggggtcggggaccggggaaacccggtaccgtaaaccggttccccggtacgggtaacccccgttcccggtaccggtaccccggaaacccggtccccggaaccgggttccccctttaccccccgggg

SEQ ID NO: 333942 - DNA, 588 bp, Homo sapiens
  misc_feature: GZ8MTXP02HQKK6.51.60.F05.1.454.CMB.2.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
  modified_base (418)..(418): a, c, t, g, unknown or other
  misc_feature (418)..(418): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctggagataaattgacgagataaatatgctgcctggtatcagcagaacgccaggccacgtccccngtggtcggtctatctatacaagaccaaccgagccggcccctggggactccccgtgagtcgattcgtcttaggcctccacctcgtacgggaacacgtacgcccactcctacgaccatcgacggaccggggacgtcgngggcgtggtcgggagttcggagggtctggttaccttttacgtgttccgagggcgggtacgggacgaggccgaaacgtcgtccggtccggtggttaccggggcggtaacggggaccacggtccgagtccccggtcgtcggtaccgacggtacccgaacggtcccgtcccgg

SEQ ID NO: 333943 - DNA, 574 bp, Homo sapiens
  misc_feature: GZ8MTXP02IQF95.51.60.F05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (411)..(411): a, c, t, g, unknown or other
  misc_feature (411)..(411): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccacctcagtgtccgtgtccccaggacaaacngccagcatcacctgctctgganataattgcgagataatntgctgcctggtatcagcagaacgccaggcccagtcccctggtcgtggtcagtctatcaaagaccacaacgccggccctaggggactaccccgtgacgtcgtattcctcgtcgcctccacctcgtacggaaccacacgtccactctacgaccagtcaagcggacgcaggctgngatgaggtcttagtactttacgtacgtacgnggtcggtggaacncggacgactacgtcggccggttggttccgggggacggaacgggaccgtaaacggcccgttaacggaacccgttcccggtacgggttccgaacggaccccgtaaacggtcccgtccccgg

SEQ ID NO: 333944 - DNA, 587 bp, Homo sapiens
  misc_feature: GZ8MTXP02HFKOW.51.60.F05.1.454.CMB.2.raw
  modified_base (177)..(177): a, c, t, g, unknown or other
  misc_feature (177)..(177): n is a, c, g, or t
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (374)..(374): a, c, t, g, unknown or other
  misc_feature (374)..(374): n is a, c, g, or t
  modified_base (504)..(504): a, c, t, g, unknown or other
  misc_feature (504)..(504): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggtattttgtggcctcctatgagctgattcagcccacctnagttcgtccgtcgtcccgaggacaaacngccagcactcacctactcagganaataatgacgagtaataatgtagctgccgtgtatcgagcaagacgtccgacgtcctacgtcccgtggtggtcgtcactctaactacgaacaaccctaccgaacggcccggtacccgggacgggtacttccgagacgtcgtacttcncgtcgacctccgcgtagtaccggacaccgtacgacgttactccgacacctcgacggacggcggacgtcgacgacgtaggtagagtacggcgtactcgtttacgttacggtgaaccggaggtcggaacggnacgacgcgtacgcgttacggtacgggtgggacgaggaccgacggtcgaccgtacgcgtacgcgaacgccgcgcctccgtcccg

SEQ ID NO: 333945 - DNA, 708 bp, Homo sapiens
  misc_feature: GZ8MTXP02FG1IL.51.60.F05.1.454.CMB.2.raw
  modified_base (200)..(200): a, c, t, g, unknown or other
  misc_feature (200)..(200): n is a, c, g, or t
  modified_base (501)..(501): a, c, t, g, unknown or other
  misc_feature (501)..(501): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacngcagcatccactgctctggagtaataaagttgacgaagtaattaaatagtagtcttggccttaggtactcgagacgaagaacgacccgaaggccctacgtcccctgggttgggtcggtactagttacctataccgaaaacggaacccaaccgaacggccccggtaccggtacggggaactacccccgaggtacgacgtcttacgtccgttacggtcccaccctacgtcgtacggggaaacctacgacgtccacttcacgacctagccgaaggacggacgcgtaagggcctaggtggtacgnggtaacggtctttacggttaacctttttacggacgtaccgggacggtcgggttaacgggaccgtacgaccgtaccgtaccgtcgggtcccgggtttcggtacgggggaccggggaaacgggtaccgtaaacggtccggtacccgggtccgttaccccggtccggtaaccggacccggaacccggaccggttccccggttccccccgg

SEQ ID NO: 333946 - DNA, 730 bp, Homo sapiens
  misc_feature: GZ8MTXP02F2N61.51.60.F05.1.454.CMB.2.raw
  modified_base (174)..(174): a, c, t, g, unknown or other
  misc_feature (174)..(174): n is a, c, g, or t
  modified_base (396)..(396): a, c, t, g, unknown or other
  misc_feature (396)..(396): n is a, c, g, or t
  modified_base (437)..(437): a, c, t, g, unknown or other
  misc_feature (437)..(437): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctctatgagctgattcagcccacctnagtcgtccgtgtccccaggacagacacgctagcactccacgtgctgtagggataattaagtcggagtaaagtaataaagttcgtcgacgttcgaccgttaggtacacgacgtagaacgaccgcgacgccgtacgtccgtgggtgtcgtacacttatacacgaaacgacgaacccgacgggcccggtaccggtacggacctaccgtagacggtactacgttcncggtcggtacccctccgtaccgttacggaaccggtaaaccnccgtaccgtacctacgtccgaacgacgcgtaccggacggggccggtacgcggtacggtacggtgtaacgggtcggtacgggtacgtttaccgtttaacggtttacgttcggacgggttcgggtaacggggtcgggttaaacgaccggtaacggtacgttaccgggtacggggttcccgggttacgggtaccgggggtacgggaaaccgggtaacgtaccccggtacggttccgggtaaccccggtacccggttacgacccgggacccgtacccgggtacccgttccgtccccg

SEQ ID NO: 333947 - DNA, 563 bp, Homo sapiens
  misc_feature: GZ8MTXP02J0H4B.51.60.F05.1.454.CMB.2.raw
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccacctcagtgtccgtgtccccaggacaaacagccagcatcacctgctctggagataaattgcgagataaatatgctgcctggtatcagcagagcagccagtcccctgtggtgtcatctatcaagacaccaaggccgcccgtacggggataccccgtgacgcgtacttctcctcgggcctcccacccgttccgtacggggaaaccacgacgcccacctacgtcgacccagtccagggccgggaccgcgaacgggctggtggaatcggaggtctggttaactttcgtgtcgacgggtcgttggggactaggcgactaaccgtcggccggtggtccgggaacgggcggaccgaacgcctaggaacccgtccgcggtcgaccgccgacggctaccccgg

SEQ ID NO: 333948 - DNA, 611 bp, Homo sapiens
  misc_feature: GZ8MTXP02H39OG.51.60.F05.1.454.CMB.2.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (286)..(286): a, c, t, g, unknown or other
  misc_feature (286)..(286): n is a, c, g, or t
  modified_base (328)..(328): a, c, t, g, unknown or other
  misc_feature (328)..(328): n is a, c, g, or t
tcagcgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagcccaccctcagtgtccgtgtccccaggacaaacngccagcatcacctgctctgagataaatgagagaataatntgctgctggtatcagcagaagccaggccacggtccctggtggtgtnatcatcaagacaccgaagcccggcccgtaggggactacccgngacgcgtattccgtcgtcggcctaccgacccgtccgtaggggaacccacgaacgcccctaacttcgaccgaccacgtacgacgggacgggaccgacgaggtccgtggtaggagtggacggtcgttacgttacgtttttaccgcggttacgacggggtcggtacgggaaccgaggacgtaccgaacggtcggtccggttcggtacggggacgggtacggacccgaacggttcgcggtaaccccgtccgtcccggtacgaccggcccgtaacggcccgtccccgg

SEQ ID NO: 333949 - DNA, 698 bp, Homo sapiens
  misc_feature: GZ8MTXP01ERSGV.44.14.B03.1.454.CMB.2.raw
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctggcgagagggccaccatcaactgcaagtccagccagtagttgttttttacagctaccaaacaataagaactacttagctggtaccagcaagaagccaggacagcctacctaagttgcttcttttacgtcgggtctttccgtaacccgggtaacgtcccggggtccctcggaccgtattcccgaggtggccgaggtccgggtactggggaactagtatttcacctctaccaccataccaaacacggccctgccaagggccttaggaaagagttggtcgggtactttaggtttttaactttaaccggttaggtttaaccaaaaccgtaaagggtaacgtacctaactttccctttaccccttaccccttttaagttttcccgtttttaccgggacccggtaaacgggggtaccccttaaaaggtcccgttaaggggaagtaaacttaaccgaaaaaccggttaacgttgggtacgggtccttagggacccacccgttaagttccctttccgg

SEQ ID NO: 333950 - DNA, 570 bp, Homo sapiens
  misc_feature: GZ8MTXP01C7426.44.14.B03.1.454.CMB.2.raw
  modified_base (309)..(309): a, c, t, g, unknown or other
  misc_feature (309)..(309): n is a, c, g, or t
  modified_base (398)..(398): a, c, t, g, unknown or other
  misc_feature (398)..(398): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgtttttacagctaccaaacaataagaactactagctggtaccagcagaagccaggacagcctcctaagtgcttctttacngggtcttccgtaacccgggacgtccggggtccctgaccgattccaggtgcgaggcggtctgggcagtatttcactctacacatcaacancctgcaggctagaagtatgtgactactttatttcgtgttcctgactaattattactaccttcccctagttaccttaggttttcgggccgtaacggggtaaccaaggggttaggaagtaaacgttagaaaagggttacttaggttaaggcgtgtaccaccattccgttgttcc

SEQ ID NO: 333951 - DNA, 555 bp, Homo sapiens
  misc_feature: GZ8MTXP01BD6A9.44.14.B03.1.454.CMB.2.raw
  modified_base (307)..(307): a, c, t, g, unknown or other
  misc_feature (307)..(307): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagacttcctggccctgtctctgggcgagaggccaccatcaactgcacgtccagccagagtcttttctacagctccagcaataggaactacttactggaccaacagaaaccaggcagccctcccagactactctatttacnggcatccgtaacccgggaatcccgggggtccctgaccgattccgaggtggcaggcgggtctgggcagtatttcactctcacatcagcagcctgcgaggctgaagatgtgcttgtttatactgtacaaagtagacgctattccttcctcccttatttccgtttcgggccctaaggggaaccctaaggccgtagggaacttaacgttacaaacgtaacgtggtcgcgtcgacctaaccgttaacgttccg

SEQ ID NO: 333952 - DNA, 528 bp, Homo sapiens
  misc_feature: GZ8MTXP01BV6TR.44.14.B03.1.454.CMB.2.raw
  modified_base (372)..(372): a, c, t, g, unknown or other
  misc_feature (372)..(372): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactacttagcttgacagcagaagcaggacagcctcctaagttcgcttcttttacgtggtcttcgtacccgggaatcccgggggtccctgaccgattcgacgtggcgaggcgggtctgggacngtactttcacttctcaccatcaacacgcctgcaggctagaagatcgtaggcctatttattctggtctgtacaattatactactccctgtactagtttggacctagggaaccaggttcgagagtacgaagacgttgnggntgcacagttctgttctc

SEQ ID NO: 333953 - DNA, 522 bp, Homo sapiens
  misc_feature: GZ8MTXP01CIT23.44.14.B03.1.454.CMB.2.raw
  modified_base (308)..(308): a, c, t, g, unknown or other
  misc_feature (308)..(308): n is a, c, g, or t
  modified_base (484)..(484): a, c, t, g, unknown or other
  misc_feature (484)..(484): n is a, c, g, or t
  modified_base (511)..(511): a, c, t, g, unknown or other
  misc_feature (511)..(511): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgtttttacagctaccaacaataagaactacttagcttggaccagcagaagccaggacagcctcctaagttgcttctttacnggtcttcgtacccgggaatccggggtcctgaccgattcagtggcaggcgggtctagggactgtactttcacttctaccacatacaacagcctgcaggctagaagatgtgctactttattctgtctgactaatattactacctccctgtactgtttcgcgagggaaccaggttgagngtaacgaaggacgttgttggctgcacnttctgttcttc

SEQ ID NO: 333954 - DNA, 538 bp, Homo sapiens
  misc_feature: GZ8MTXP01B6ZXF.44.14.B03.1.454.CMB.2.raw
  modified_base (367)..(367): a, c, t, g, unknown or other
  misc_feature (367)..(367): n is a, c, g, or t
  modified_base (523)..(523): a, c, t, g, unknown or other
  misc_feature (523)..(523): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagaggccaccatcaactgcaagtccagccagagtgttttttacagtctaccaaacaataagaactacttagcttggacagcagaagcaggacagcctactaagtgcttctttacgtggtcttcgtacccgggtaactccggggtccctgaccgatcagtggcagcggtctgggacnggtattcactctcacatacacagctgcaggctagaagatgtggctactttattcttggtactgctaattattactaccttccctagtactaggtttcgaccgaggggtaaccaagggttcggagagtacgaaggttacgttggttagctgctaccngttctcgttcttaac

SEQ ID NO: 333955 - DNA, 533 bp, Homo sapiens
  misc_feature: GZ8MTXP01DRXJ6.44.14.B03.1.454.CMB.2.raw
  modified_base (527)..(527): a, c, t, g, unknown or other
  misc_feature (527)..(527): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctggcgagagggccaccatcaactgcaagtccagccagagttgtttttacagctaccaaacaataagaactactagctggtaccagcagaagccaggacagcctcctaagttgcttctttactgggtcttcgtaacccgggaatcccggggtccctgaccgattccagtggcagcgggtctgggcagtatttcactctcacatcaacagcctgcaggctgaagatgtgcttagtttattacgtgtacaaacaagagcatccttcctcccttatttctttcggccgtaaggggaccaaggcttggaagtattacgaaacgttacgtgtcggcctgccacctnttctcg

SEQ ID NO: 333956 - DNA, 550 bp, Homo sapiens
  misc_feature: GZ8MTXP01BJJFT.44.14.B03.1.454.CMB.2.raw
  modified_base (368)..(368): a, c, t, g, unknown or other
  misc_feature (368)..(368): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactactagcttggaccagcagaagccaggacagcctcctaagttgctcttttactgggcttcgtaccccgggaatccgggggtccctgaccgattcacgtggcaggcggtctgggacngtatttcactctcaccatcacagcctgcagctagaagatgtgctactttatttctggtctgtctaatattataccttcccctagttactagttttcggaccgtaggggtaaccgtaagggttggaagagtaccgaaaaggttaacgttggttaggccgtagctacctattctcgttcttccg

SEQ ID NO: 333957 - DNA, 761 bp, Homo sapiens
  misc_feature: GZ8MTXP01CBFEF.44.14.B03.1.454.CMB.2.raw
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagaggccaccatcaactgcaagtccagccagtagtgtttttacagctacaacaaataagaactactagcttggaccagcagaagccagacagcctcctaagttcgcttctttacgtggtcctttaccgtaaccccgggaacgttcccggggtccctaggacccgtagttccgtaaggttcggcgagggtccggggtcgttacgggggaacctaaggtactttttacccgaaaccttcccttaccaacccctaaacttaccaaaacccgtaagacccccgttgacccgaagggtacccgttaagggaaaacgtcgttagggttacgggtacctttaaaccttttttagttttacccgtttaggggtttccctttaggtaccttaaactttaagtttaaaccttaacccctttccccgtttagttaacccgtttaggtttttccgggaaccggtaacgggggtaaacccgtaaggggttagggtaaacgttaagttaaaccggaaagggttaaccgttgggttaggtcccgttaggaacctacccgtagttccttaacgttccgtttaaccc

SEQ ID NO: 333958 - DNA, 578 bp, Homo sapiens
  misc_feature: GZ8MTXP01C79IJ.44.14.B03.1.454.CMB.2.raw
  modified_base (301)..(301): a, c, t, g, unknown or other
  misc_feature (301)..(301): n is a, c, g, or t
  modified_base (411)..(412): a, c, t, g, unknown or other
  misc_feature (411)..(412): n is a, c, g, or t
  modified_base (428)..(428): a, c, t, g, unknown or other
  misc_feature (428)..(428): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagacgggccaccatcaaactgacaagtccagccagtagttgtttttacagtctaccaacaataagaactactagcttggacagcagaacgcaggacagcctactaagttncttctttacgtggtcctttccgtacccgggtaatcccggggtccctgaccgattcgacgtggcaggtcgggtcgtgggactaagtactttcgactctcaccatacaaacnncctgcagctagaagtntgtagctactttattctgggttctagactaatacttactccttccctagttactggtttcgcccgaagggaacctagggttgacgaagttaacgaaaaggttaccttgggcggtaactcgccctaacgtcttcgttcgttaacctttccg

SEQ ID NO: 333959 - DNA, 639 bp, Homo sapiens
  misc_feature: GZ8MTXP01AL76J.44.14.B03.1.454.CMB.2.raw
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (399)..(399): a, c, t, g, unknown or other
  misc_feature (399)..(399): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagacctccctggctgtgcctctgggcgaggacgggccaccagtcaactgctagtccagccagtagttgtttttacagtctaccaaacaataagaactacttagcttggaccagcagaagccaggacagcctacctaagtcncttcttttacgnggtcctttaccgtaccccgggtaagtcccgggggtaccctgaccctattccaggttcggcaggccgggtctacggggaccnggtactttccgactcctacacctatccaacagtccctagccgaaggctagaacgtatcgtggaccttagttttacttctcgggtctgacctaaattacttactcccttacccctagttacgttacggttttacggaccggtacgggggtaaccgtaaagggttcgggaaagttacgttaaaccggaaagttaccgttggttaggcctggccaacccgtattcgttccgttctttaacccg

SEQ ID NO: 333960 - DNA, 685 bp, Homo sapiens
  misc_feature: GZ8MTXP01C3KMT.44.14.B03.1.454.CMB.2.raw
  modified_base (320)..(320): a, c, t, g, unknown or other
  misc_feature (320)..(320): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctcgtgggcgagacgggccaccatcaactgacaagtccagccagtagttgtttttacagctaccaaacaataagaactacttagctggtaccagcaagaacgccaggacagccctacctaagttgcttcttttacngggtctttaccgtacccgggaattcccgggggtccctacgaccgtacttccgaggtcggcgaggccggggttcgtaggggaactaggtacttttacactcctacaccatacccaaacacgcctgaccgaagggcttagggaaagtgtaggtacggtacttaacgtttttactttcggttacgttcgttagtactaaattactttaacttacccttcccccttagtacttaggttttccgggaccgtaaacggggggtaacccttaaagggggtcggaaacgtaacgttaacgaaaaaagggggttccttggggtaacggggtccttaacggacccgtaaacccttacgtttccgttcgttaaccc

SEQ ID NO: 333961 - DNA, 582 bp, Homo sapiens
  misc_feature: GZ8MTXP01EMCA5.44.14.B03.1.454.CMB.2.raw
  modified_base (409)..(409): a, c, t, g, unknown or other
  misc_feature (409)..(409): n is a, c, g, or t
  modified_base (426)..(426): a, c, t, g, unknown or other
  misc_feature (426)..(426): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagtagttgtttttacagctaccaaacaataagaactactagctggtaccagcaagaacgccaggacagccctctaagttgcttctttactgggtcttaccgtacccgggtaacgtcccggggtccctgaccgtattccgaggtgcaggcgggtctgggcagtactttcactctcaccatacaacancctgcaggctagaagtntggtcgtacttactttattcgtgtctgactaattattactacccttacccgtgttacgtaggttttcggaccgtaaggggtaccgttaagggtggaagtacttaacgaaaaggttcgttaggtcgggcttcggctaccttagtccttaagtttccc

SEQ ID NO: 333962 - DNA, 599 bp, Homo sapiens
  misc_feature: GZ8MTXP01D1HN3.44.14.B03.1.454.CMB.2.raw
  modified_base (295)..(295): a, c, t, g, unknown or other
  misc_feature (295)..(295): n is a, c, g, or t
  modified_base (361)..(361): a, c, t, g, unknown or other
  misc_feature (361)..(361): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgacaagtccagccagagttgtttttacagctaccaaacaaataagaactactagcttgaccagcagaagcagacagcctctaagtncttctttactggcttcgtacccgggaatccggggtcctgacgatcagtggcagcggtctagggacngtatttcactctcaccatacaacagcctgcgagctagaagtagtgcgtctactttatttcgtcggtcttgactaattacttactaccttcccttacgttacttagttttacggccgtaaggggtaacccgtaagggttaggtaaacgttaagttaaccgaaaagggttaaccgttggttacgggtaaccgttacggaacccgtaacccctaagttaccttcggtttccgtttaacccg

SEQ ID NO: 333963 - DNA, 542 bp, Homo sapiens
  misc_feature: GZ8MTXP01D5BE2.44.14.B03.1.454.CMB.2.raw
  modified_base (299)..(299): a, c, t, g, unknown or other
  misc_feature (299)..(299): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (417)..(417): a, c, t, g, unknown or other
  misc_feature (417)..(417): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgtttttacagctaccaacaaataagaactacttagcttggaccagcagaagccaggacagcctcctaagttncttcttttactggtcttcgtaccccgggtaatcccgggggtccctgaccgtattcacgtggcagcgggtctaggggacngatttcactcncacatcaacagcctgcagctagagatgngctactttattctggtctgactaatattatcctcccctagttactgttttcgacgaggggtaaccagggttggagttagtacgaaagttaacgttggttggctagccacattcctgttcttaacc

SEQ ID NO: 333964 - DNA, 553 bp, Homo sapiens
  misc_feature: GZ8MTXP01D68O6.44.14.B03.1.454.CMB.2.raw
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagtagttgtttttacagctaccaaacaataagaactactagctgtacagcagagcaggacagcctactaagttgcttctttacgtgggtcttccgtaacccgggtaacgtcccgggggtccctgaccgtattcccaggtggcaggcgggtctgggcagtactttcactctcacatcaacngcctgacaggtctagaaagtntggtcgtactacttttactttcgtgttcctgaactaattacttactacctcccctgtactaggtttcgaccgaagggcaagggtgagtaatacgaaaagcttggtgctcgctaccgttattcttgttcc

SEQ ID NO: 333965 - DNA, 567 bp, Homo sapiens
  misc_feature: GZ8MTXP01DVT8E.44.14.B03.1.454.CMB.2.raw
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
tcagacagtatatacacgaccggtgctcgatttagtgtgagtagttccgcggggagctacaacaggcaggcaggggcagcaagatggtgttgcagacccaggtcttcatttctctgttgctctggatctctggtgcctacggggacatcgtgatgacccagtctccagactcccctggctgtgcctctgggcgagagggccaccatcaactgcaagtccagccagagttgtttttacagctccaaacaataagaactacttagctggtaccagcaagaagccaggacagcctacctaagttgcttctttactgggcctttcgtacccgggaatcccggggtcctgaccgattccagtggcaggcggtctgggcagtatttcactctcaccatcaacagcctgcagggctagaaagngtgtggctaacgttttatttcggtgttctgtactaaatnttactaccttcccctgtactagtttcgccgtaaggggaccttaagggtcggaaggattacgaaaacggttacttgggtgggacttgccgaccttagttccttaaggtttccc

SEQ ID NO: 333966 - DNA, 635 bp, Homo sapiens
  misc_feature: GZ8MTXP01DOIHT.44.14.B03.1.454.CMB.2.raw
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctatggtgcctacggggacatcgtgatgacccagtctccggactccctggctgtgcctctgggcgagagggccaccatcaactgcaagtccagccagtagttgtttttacagtctaccaacaataaagaactacttagcttggtacagcaagaagccaggacagcctactaaagttntcttcttttactggtcttccgtacccgggtacgtcccgggtcctgaccgattcgagtcgcgagtcggtctgggaactagtcttcacgtctacacctactacaaacncgtcctgccgaggacttaggaaagtagttcggtcggtaccttaacgtttttaactttcgttacgttcttagtaccttaaatttaacttaccttaccttcccccttagtttaacgttacgggtttttacggaccggtaaaggggtaccgtaagggttacgaggtaacttaacgtaaaaggtaacttgggttcgacgtgaccaactacgtcttgtccgttcgttaacc

SEQ ID NO: 333967 - DNA, 549 bp, Homo sapiens
  misc_feature: GZ8MTXP01CA1R6.44.14.B03.1.454.CMB.2.raw
  modified_base (355)..(355): a, c, t, g, unknown or other
  misc_feature (355)..(355): n is a, c, g, or t
tcagacagtatatacacgaccggtgctcgatttagtgtgagtagttccgcggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctaccaaacaataagaactactagctggtaccagcagaagccaggacagcctactaagtgctctttactggcttctaccggaatccgggtcctgaccgtattccagtggcagcggtcngggcagtattcgactctcacatcaacagcctgcaggctagaagatgtcggctactttatttcgtgttactgactaaattattactaccttccccttgtacctaggttttcggccgaagggggtaccttaagggttggagtaagtacgttaaaagggaccttggtaacggctggaccaccgttatcgttgtttcc

SEQ ID NO: 333968 - DNA, 615 bp, Homo sapiens
  misc_feature: GZ8MTXP01CQE8A.44.14.B03.1.454.CMB.2.raw
  modified_base (473)..(473): a, c, t, g, unknown or other
  misc_feature (473)..(473): n is a, c, g, or t
  modified_base (595)..(595): a, c, t, g, unknown or other
  misc_feature (595)..(595): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctgggcgaggacgggccaccatcaactgcaagtccagccagtagttgtttttacagtcctaccaaacaataagaactacttagctgtacagacagaacgccaggacacgcctacctaagttcgctttctttacgtcgggtcctttacccgtacccggggaacgttccccggggtccctacggaccgtacttcccgaggtcggcgacggtccggggtacgtggggaactaggtactttccgaactctaccaccataccaaacgacgcctggaccagggctaggaaagnttcggtacgaccttacgttttactttccgtgttcctgactaattattacttaccttcccttagtacgtgtttcggccgaaggggtaccagggtagagtagtacgaaaggttacttggtgtcngccacttagttcttgttccc

SEQ ID NO: 333969 - DNA, 644 bp, Homo sapiens
  misc_feature: GZ8MTXP01B0N83.44.14.B03.1.454.CMB.2.raw
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgtttttacagctaccaaacaataagaactacttagctaggtaccagcagaagccaggacagcctctaagttgcttctttacgtcgggtcctttaccgtaccccgggtaacgttcccgggggtccctggaccgtattccgaggtggcaggcggtcgtagggaacagtactttcacgtctacaccatacaacagcctgccaggctagaagacgtggtcgcttaacttttactttcgttcgttctagacttaattactttaactacccttaccccttagttaccgttacggttttaccgggccggtaacgggggtaaccgttaaggggtacggaacgtaaacgtaaccggaaaagggttaaccgttgggtaacggtccgttaacggaccctaccgttacgttccgttaacggtttccc

SEQ ID NO: 333970 - DNA, 620 bp, Homo sapiens
  misc_feature: GZ8MTXP01DNB46.44.14.B03.1.454.CMB.2.raw
  modified_base (392)..(392): a, c, t, g, unknown or other
  misc_feature (392)..(392): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagtagttgtttttacagctaccaacaaataagaactacttagcttggaccagcaagaagccaggacagcctacctaagttcgtcttcttttacgtggggtcctttcgtaaccccggggtaatccccgggggtccctcgaccgattccagtggcaggcgggtctggggaacnggtatttcgactctccaccatcaacagcctgcaggctagaagtatggtggtctacttttatttccgttgttctgtactaattacttactacccttcccttagttacgttaggtttacggaccggtaaggggtaaccgtaagggttcggtaaagttaagtaaacgtaaagggttaacgttgggttacggtcgtacgaaccgtacctacttccgtttcgttcctttaacc

SEQ ID NO: 333971 - DNA, 716 bp, Homo sapiens
  misc_feature: GZ8MTXP01AZT6N.44.14.B03.1.454.CMB.2.raw
  modified_base (443)..(443): a, c, t, g, unknown or other
  misc_feature (443)..(443): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgccgtacggggacatcgtgatcgacccagtctccagactccctggctgtcgcctcgtgggcgaggacgggccaccatcaactgacaagtccagccagtagttgtttttacagctaccaaacaataacgaactactagtctaggtacagacaagaacgccaggacacgccctactaagttcgtctttacttttacgtggtccttaccgtaacccgggaacgtcccgggtccctagaccgtattccgaggtcgacgaggccggtacgtacgggaacgagtactttccaaccttcaccaacactacaaacncgtcctgaccgaggtcctagaaacgtgttcggtacggtactttaacttttacgtttccggttggttacccttataaacttaaactttaacttaccttaccccgttaccccgtttagttaaacccgtttacggttttaccggggaccccgggtaaagggggtaaacccgttaaagggggttcaaacggtaacttaacggggttaaaaacggttccggttagggttaaccgggacttaaccggacctacccttagtttccggttcgttttaaccc

SEQ ID NO: 333972 - DNA, 736 bp, Homo sapiens
  misc_feature: GZ8MTXP01DOG4W.44.14.B03.1.454.CMB.2.raw
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctcgtgggcgagagggccaccatcaactgcaagtccagccagtagttgtttttacagctaccaaacaataagaactactagctaggtacagcaagaacgccaggacagacccctaccgttaagtttcgtcctttacttttacgtcggggtcctttacccggttaaccccgggggaacgttccccgggggttccctacggaccgtactttccgaggttcggcgtagggtccggggtacgtacggggaactaggtactttccaccttcctaccaacctaacttacccaaaaccgtcggtccccgtaggaccgtaacggggacttaagggaaagtagttcggttacggactttaactttttacgtttcggtggtttacttagtaaccttaaattactttaccttacccttccccgttaggttaccttacggtttcgggaccccgggtaaaggggtaacccgttaaaggggtacggaaagtaacgttaaccggaaaaagggttccgttagggtcggtaccgtcggtacccacttacgttccgttaacggttttccc

SEQ ID NO: 333973 - DNA, 588 bp, Homo sapiens
  misc_feature: GZ8MTXP01AEY50.44.14.B03.1.454.CMB.2.raw
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgccgtacggggacatcgtgatgaccagtctcagactcctggctgtgcctcgtgggcgaggacgggccaccgatcaactgacaagtccagccagtagttgtttttacagtctacaaanaataagaactactancttagacagcagancgagacacgcctactagtgtcttctttacgnggtctcgtaccgggagtccgggtctgactatcnggtgcgagtcggtnagggactgtactcactcctacactatacaacncgcngacgtagctaagagtatacgtacgtacttagtttcttcttcgttacgtacgtactaacttaacttacttaccttaccgttacgttacgttacgttacggtacggtaacgggtaacggtacggttaggtaacgaacgtaacgtaacgttacgttcgttacgtaacgtacgtaactactacgttcgttcgttcgtcg

SEQ ID NO: 333974 - DNA, 841 bp, Homo sapiens
  misc_feature: GZ8MTXP01A1XXF.44.14.B03.1.454.CMB.2.raw
tcagacagtatatacacgaccggtgctcgatttagtgtgagtagttccgcgggggctacaacaggcaggcaggggcagcaagatggtgttgcagacccaggtcttcatttctctgttgctctggatctctggtgccgtacggggacatcgtgatcgacccagtctccagacctccctggctgtcgcctcgtgggcgaggacggccaccatacaactgacaagtccagcctagtagtttgtttttacacgtacctaccaaactaaataacgaacttacgttagacttacggaccagcaacgagaccgaggacacgtccctacgtaagttcgtctttcgtttacgtcggtacctttacccggtaacccgggtacgtccccgggtacctacggacccgtatccgaccggtcggcgacggtccgggtcgtaagggacctaaggtacttacccaccgttcctaccctaccaattacccaacgaccgtccgtacggaccgtaacggtacgtaaagggtacgtaggttcgttaccgggttaccctttaacgttttttacgtttccgttacggttaccgttaacggttaaccttaaacgtttacctttaacccgtttaccccttacccggtttaccggtttaaccgtttacgggggttttacccgggaacccgggttaaacgggggtaaaccccttaaggggggttaaacgtaaaccgggttaaacgtaaaaaccggggttaaaacgggggttacccctttggggttacccgggttaaccgttaaccgggtaacccttaacccggttaaccgtttccggtttaacccggtttaaccctttaaccccggg

SEQ ID NO: 333975 - DNA, 704 bp, Homo sapiens
  misc_feature: GZ8MTXP01BB3PK.44.14.B03.1.454.CMB.2.raw
  modified_base (306)..(306): a, c, t, g, unknown or other
  misc_feature (306)..(306): n is a, c, g, or t
tcagacagtatatacacgaccggtgctcgatttagtgtgagtagttccgcgggggagctataacaggcaggcaggggcagcaagatggtgttgcagacccaggtcttcatttctctgttgctctggatctctggtgcctacggggacatcgtgatgacccagtctccagactccctggctgtcgcctcgtgggcgagacgggccaccatcaactgcaagtccagccagtagttgtttttacagctaccaaacaataaagaactactagctgtaccagcaagaacgcaggacagccctactaagttncttactttacgtggtcctttccgaacccgggtaacgtccccgggggttaccctggtaaccgtattaccccgaggttcggactacgggtcggggtaactcgggaacagtacgtttaccactcctacaaccactaccaaacaccggtcctagacgtacggcttaaggaagtatggtcggtaacttacgtttttacgttcgtcgtttcgtacgtaaccgtaaatttacttaaaccgttccctttaaccccgttgttaaacccgtttaagggttttcccgggaacccgggtaaacgggggtaaacccaagggggttaagaacggtaacgtaaaaccggttaaaagggttaccttggggttaacgtcgtaacgtcgacccttacggttcctttcgtttaaccc

SEQ ID NO: 333976 - DNA, 741 bp, Homo sapiens
  misc_feature: GZ8MTXP01DB5EC.44.14.B03.1.454.CMB.2.raw
  modified_base (409)..(409): a, c, t, g, unknown or other
  misc_feature (409)..(409): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctcgtgggcgagagggccaccatcaactgcaagtccagccagtagttgtttttacagctacaaacaataagaactactagctggtaaccagacaagaacgccaaggacacgtccctaccgttaaagttcgcctttacttttacgtcgggtacctttcccgtaacccggggaacgttcccgggggtccctaggaccgtattcccaggtcggcgacggcgggttcgngggaacagtactttccactcctacaccactacaacgacgcctagacgacggactacggaaagtagttacggtcggtacttaaccgtttttagtttcttacgggtttccgtaagtaaccttaaatttcgtttaaccttaaccctttacccccgtttaggtttaaaccttcgggggtttttaacgggaccccggggtaaacggggggtaacccgttaaaagggggtgggttaaacgggttaaactaaacgggggttaaaaacgggttaccggttaggggtaacggtaccgttcgggaacctacccggttaattcccgtttaacggttttaaccc

SEQ ID NO: 333977 - DNA, 664 bp, Homo sapiens
  misc_feature: GZ8MTXP01CXMS6.44.14.B03.1.454.CMB.2.raw
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (616)..(616): a, c, t, g, unknown or other
  misc_feature (616)..(616): n is a, c, g, or t
  modified_base (633)..(633): a, c, t, g, unknown or other
  misc_feature (633)..(633): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgccgtacggggacatcgtgatgacccagtctcagactcctggctgtcgcctcgtgggcgaggacggaccacatacaactgacaagtccagccaagtagtttacgtttttaacagtcctaaccaaactaaataaacgaacttactagtcttacggacagacaagaacgccgaaggacacgtaccctacgtaaagttctacctttacgttttaacgtcgggtacctttaccggtaacccggggtaacggttccccggggttaccctagaacccgtattaccgaggtcgggacgacgggtcgggtacgtaacgggactaacggttactttaccaccttctaccaacctataccaaacgcnccgngacgagtctaggaaagtgtgggctactttacgttttattccgtagggtcttaacacttaaattacggttacttacccgtcccttaagtaacgtggtttacgaccggagggtaaccaaggttnagagtaacgaaaggttnttggactctacgaactctagttctcttcgtc

SEQ ID NO: 333978 - DNA, 837 bp, Homo sapiens
  misc_feature: GZ8MTXP01C94WM.44.14.B03.1.454.CMB.2.raw
  modified_base (301)..(301): a, c, t, g, unknown or other
  misc_feature (301)..(301): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagtactccctggctgtgcctcgtgggcgagacgggccacatcaacgtgcaagtccagccgagtagttgtttttacagtctaccaacaaataagaactattagcttggacagcagaagcagacagcctactaagttncttacgtttacgcgggtaccttccggtaaccccggggtaagtccccgggggttaccctacggtaacccgtagtttaccgaaggttcggggacgtaacggggtcccgggggttaccgttacggggggaaccttaacgggttactttttacccggaaacccgtttaccccgttacccgaaacccctaacgttaaccccaaaaccgtaacggtaccccgttacggaccggaacgggtacccgttaacggaaaacggtagttacgggttacgggttaaccgttaacttttttaaacgttttccgtttacgggtttacccgttaggtaaaccttaaagtttaaacgttttaaccttaccccgtttacccgtttaaccggttaacgtttaccgggtttttccgggacccggtaaacgggggttaaacccgtaaggggttaccggggtaaagttaaacggtttaaacggaaaacgggttaacggttcgggttacggtcgttacgtaaccgtaccgtacgttaccgttcgttccgtttaacccg

SEQ ID NO: 333979 - DNA, 602 bp, Homo sapiens
  misc_feature: GZ8MTXP01E4W1Q.44.14.B03.1.454.CMB.2.raw
  modified_base (311)..(311): a, c, t, g, unknown or other
  misc_feature (311)..(311): n is a, c, g, or t
  modified_base (571)..(571): a, c, t, g, unknown or other
  misc_feature (571)..(571): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtcgcctcgtgggcgagacgggccaccatacaactgcaagtccagccagtagttgtttttacagtctaccaaacaataagaactactagctaggtaccagcaagaacgaccaggacacgcctactaagttncttactttacgtcggtctcgtaacccgggaacgtcccgggggtcctagaccgtattccgaggtcggacgacggtcgggtacgtagggaacctagtactttacgactctaccaacactacaacacgcctgacgaggctagaagagtgtgtactactttatttcgtgtactagtactaaattacttacttacctacccctagtacgttaggtttcggaccgaaggggaaccgaaagggtcgaagtaactaacgaaaggttcnggtgactcgtacaccttatcgttcgttaacc

SEQ ID NO: 333980 - DNA, 778 bp, Homo sapiens
  misc_feature: GZ8MTXP01DUO4O.44.14.B03.1.454.CMB.2.raw
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtcgcctcgtgggcgagacgggccaccatacaactgcaagtccagccagtagttgtttttacagactaccaaacaataagaactatagctggtacagcaagaacgccaggacacgtaccctaccttaagttcgtacctttacgtttttaacgtcgggttacctttaccccggttaaaccccgggggaacgtttccccgggggttcccctacggtacccgtaacgtttccccgaagggttcgggcgtacggggtccgggttaccgtacggggtaactacgggttaacttttacccaccttcctaccaacccgtaacttacccaaacgacgtcccgtgaccgaagggtaccttaagggaaacgtagttcgggtacgtacctttacgtttttacgtttcgtacggtttcgttactaaacttaactttactttaaccttaccccgttaccccgtttaggttaccgtttacgggttttacgggacccggtaaacgggggtaacccttaaagggggttacgttaaacggtaagtaaccggaaaaagggttcgttacggtcggtaacgtccggtaccaaccgttctttccgttcggttttaaccc

SEQ ID NO: 333981 - DNA, 753 bp, Homo sapiens
  misc_feature: GZ8MTXP01D6MFM.44.14.B03.1.454.CMB.2.raw
  modified_base (520)..(520): a, c, t, g, unknown or other
  misc_feature (520)..(520): n is a, c, g, or t
  modified_base (722)..(722): a, c, t, g, unknown or other
  misc_feature (722)..(722): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgccgtacgggacatcgtgatcgacccagtctccagtacctccctggctgtcgcctcggtgggcgaggacggccaaccataccaactgacaacgtccacgacctagttagtttgtttttaacacgtacctaaccaaactaaataacgtaacttacgttacgtcgttacgaccagacgaagaacgacgaacggacctacgtcccttaacgtaagttcgtacctttcgtttacgtcggttaccttaccggtacccgggtacgtcccgggtcctacgtaccgtacgtacgtacggtcgggacgacggggtcggtcggtaacggggtaacttaacggttaccttacctacccttaccctaccgtaactaacgtaccaaaccgcgttacccgnggaacggtacggacgttaaacggaaacgttcggtacgtacctttaacctttgttttccgtacggttacgttacgtaaccttaaatttacctttacctaaccccttcccggtttagttacgtttacggtttacccgggaacggtaacgggtaacgtaaggtggaacgtaacgttaaacggtaaaccgtgttgttcggttaccngacctctagtcttcgttaacttccgttaacc

SEQ ID NO: 333982 - DNA, 860 bp, Homo sapiens
  misc_feature: GZ8MTXP01BWNCS.44.14.B03.1.454.CMB.2.raw
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagacctccctggctgtgcctcgtgggcgagacgggccaccatcaactgacaagtccagccagtagttgtttttacagtcctaccaaacaaataagaactacttagcttggaccagcaagaagccaaggacacgcctaccgtaagttcgcttcttttacgtcgggtcctttaccggtaaccccgggtaacgttccccgggggtacccctaggtacccgtattcgaacggttcggacgtacgggtccggggttcgtaacgggggaacctaaggttacttttccgaccttacccgttaccaaccctaaacgttacccaaaacccgtacgtccccgttacgggacccgtaacggggtcccgttaaagggtaaaggtaaccggtttgggttaaccgggttaccctttaaaccggtttttttaacttttccgttacgggggtttacctttacggtaaccctttaaattttaaacctttaacccttacccccgtttacccccgttaagggtttaaacccgtttacggggtttttcccgggaaaccccgggttaacggggggtaaaccccgtaaaagggggtttgggtaaaacgttaacgttaaaccgggtaaaaacgggttaacccgtttggggttacggtaacccgttggaaccccttaaccgtaacgtttccgttaaccggtttaaccgttttaaccccg

SEQ ID NO: 333983 - DNA, 910 bp, Homo sapiens
  misc_feature: GZ8MTXP01EWDJS.44.14.B03.1.454.CMB.2.raw
tcagacagtatatacacgaccggtgctcgatttagtgtgagtagttccgcgggggctacaacaggcaggcaggggcagcaagatggtgttgcagacccaggtcttcatttctctgttgctctggatctctggtgccgtacggggacatcgtgatgacccagtctccagactccctggctgtgcctcgtgggcgaggacgggccaccatcaactgacaacgtccagcctaagtagtttgttttttaacacgtacctaccaaactaaataaacgtaaacttacttagtcgttacggtaccagacaagaacgaccgaaggacacgtaccccttaccgtaaagtttcgtactttaccgttttacgtcggggttacctttacccggtaaccccgggggtaacggttcccccggggggttacccctacggtaaccccggtacgtttaccggtaacggggttcgggtacggtaacgggggttcccgggggttaccggttaacgggggaaaccgttaacgggtttaacttttacccgaccctttaccctaccctaaaccccgtaactaaacccctaaaaccgtaaaccggccccggttacggaacccggtaagggtacccggttaaaacgggaacggttaaacgtttgggggttaaccgggttacccgtttaaacgttttttaaactttccccggtttaagggttcggtttaaccgtaaacttaaaactttaacggttttaaacccttaccccgtttaccccgtttacggtttaaccggtttaacgggtttttacgggaacgggtaaacgggggtaaaccgggtaaacgggttagggaaacgttaacgttaaaagggccccaaaaggttcgttcggtaacgcctaaccgactacggttacttaaccgttgttaacccc

SEQ ID NO: 333984 - DNA, 665 bp, Homo sapiens
  misc_feature: GZ8MTXP01BWECK.44.14.B03.1.454.CMB.2.raw
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
  modified_base (628)..(628): a, c, t, g, unknown or other
  misc_feature (628)..(628): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatcgacccagtctccagacctcctggctgtcgcctcgtggcgaggacgggccaccatacaactgacaagtccagccagtagttcgtttttacagctaccaacaaataagaactacgttancttagaccagacagagacaggacagcctctaagttcncttactttacgtcggtcctttccgtaccccgggtaacgtcccggggtccctacggacctagttcaccgccgccgtaggtccgggtcgtacgggacaacgacgttccgctaccgtaccaaccgactacccgaaccggtcgtcgacggagggtaggaactagttacttacgacctaaatttactactagtacacggtcgtttaagtttaccgtttaacgaaccggtcccctcggtacggttccgggggaccgggggtacgtaggggtacgacgtaacgtacggttaacggtaccttgggtacggccgttagttccaccgttntccgtcgttactcccttaacgttcccttaacccgtcc

SEQ ID NO: 333985 - DNA, 529 bp, Homo sapiens
  misc_feature: GZ8MTXP02JIQSX.44.14.B03.1.454.CMB.2.raw
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
  modified_base (508)..(508): a, c, t, g, unknown or other
  misc_feature (508)..(508): n is a, c, g, or t
tcagacagtatatacacgaccggtgctcgatttagtgtgagtagttccgcggggctacaacaggcaggcaggggcagcaagatggtgttgcagacccaggtcttcatttctctgttgctctggatctctggtgcctacggggacatcgtgatgacccagtctccagactccctggctgtgcctctgggcgagaggccaccatcaactgcaagtccagccagagtgttttacagctccaacaataagaactactagcttggtaccagcagaagccaggacagcctcctaaagttgctctttacnggcttctacccgggaatccggggtccctgaccgattcacgtggcagcgggtctggggacngactttcactctcaccatcaaacagccctgccaggctgaagatgtggctacttttattcctgtctgactaattattatacctccccttgtacctagttttcgaccgaggggaccaaagggtggacgaattcgaaaaggtactggnggcctgcaccatcctgtcttc

SEQ ID NO: 333986 - DNA, 609 bp, Homo sapiens
  misc_feature: GZ8MTXP02H22MU.44.14.B03.1.454.CMB.2.raw
  modified_base (297)..(297): a, c, t, g, unknown or other
  misc_feature (297)..(297): n is a, c, g, or t
  modified_base (417)..(417): a, c, t, g, unknown or other
  misc_feature (417)..(417): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctcgtggggcaggacgggccaccatcaaactgacaagtccagccaagagttgtttttacagtctaccaaacaaataagaactactagcttaggaccagcaagaagccaggacngcctactaagtgcttctttacgtggtccttcgtacccgggtaacgtcccgggtaccctggaccgtattccgaggtcggacgaggtcgggtcgtaggactagtatttccactctacactanacaacacgcctgcaggctagaatagtgtagtactacttttattctgttctatacttaattacttaactccctttaccccgtagttaaccgttacgttttacgggacccggtaagggggtaaccctaaaggggtaggaaacgtataaccgaaagtaacgtggtaacggactcgacctactactcgttcttacc

SEQ ID NO: 333987 - DNA, 495 bp, Homo sapiens
  misc_feature: GZ8MTXP02JXEIJ.44.14.B03.1.454.CMB.2.raw
  modified_base (361)..(361): a, c, t, g, unknown or other
  misc_feature (361)..(361): n is a, c, g, or t
  modified_base (478)..(478): a, c, t, g, unknown or other
  misc_feature (478)..(478): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactactagctggtaccagcagaagccaggacagcctcctaagttgctctttactgggcttctacccgggaatccggggtcctgaccgattcagtgcagcgggtctgggacngatttcactctcaccatcaacagcctgcaggctgaacgatgtggctactttattctgtctgcatattatactccctgtacagtttgcgagggaccaggtgagatacgaaagactagngcgtgcacatctgtctc

SEQ ID NO: 333988 - DNA, 502 bp, Homo sapiens
  misc_feature: GZ8MTXP02HHZJA.44.14.B03.1.454.CMB.2.raw
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
tcagacagtatatacacgaccggtgctcgatttagtgtgagtagttccgcggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactactagcttggaccagcagaagccaggacagcctctaagtgctctttactgggcttctacccgggaatccggggtccctgaccgattccagtgcagcgggtctgggcagtatttcactctcaccatcaacagcctgcaggctagaagatgtgctactttatttctgttctgtcaaatattatactcccctgtactagtttgacagggaccaaggtgagatacgaaagactagngctagcacatcttntc

SEQ ID NO: 333989 - DNA, 498 bp, Homo sapiens
  misc_feature: GZ8MTXP02HWUJQ.44.14.B03.1.454.CMB.2.raw
  modified_base (481)..(481): a, c, t, g, unknown or other
  misc_feature (481)..(481): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactacttagcttggtaccagcagaagccaggacagcctcctaagtgctctttactggcttcgtaccggatccggggtcctgaccgattccagtgcagcggtctgggcagatttcactctcacatcaacagctgcaggctagaagatgtgactactttattctgtctgactaatatatactccctgtactagtttcgactagggaccaaggtgaagatacgaaagactgngctgacactatctagtc

SEQ ID NO: 333990 - DNA, 498 bp, Homo sapiens
  misc_feature: GZ8MTXP02I3805.44.14.B03.1.454.CMB.2.raw
  modified_base (361)..(361): a, c, t, g, unknown or other
  misc_feature (361)..(361): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagacagtatatacacgaccggtgctcgatttagtgtgagtagttccgcggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactacttagcttggtaccagcagaagccaggacagcctcctaagttgctctttactgggcttctacccgggatccggggtccctgaccgattcagtgcagcggtctgggacngatttcactctcaccatcaacagccctgcaggctgaagatgtggcactttatttctgtctgcaatatatactccctgtacngtttgccgtagggaccaggtgaganacaaagaactgagcgtgacacatctgtcttc

SEQ ID NO: 333991 - DNA, 586 bp, Homo sapiens
  misc_feature: GZ8MTXP02JA7KL.44.14.B03.1.454.CMB.2.raw
  modified_base (299)..(299): a, c, t, g, unknown or other
  misc_feature (299)..(299): n is a, c, g, or t
  modified_base (354)..(354): a, c, t, g, unknown or other
  misc_feature (354)..(354): n is a, c, g, or t
  modified_base (378)..(378): a, c, t, g, unknown or other
  misc_feature (378)..(378): n is a, c, g, or t
  modified_base (412)..(412): a, c, t, g, unknown or other
  misc_feature (412)..(412): n is a, c, g, or t
tcagacagtatatacacgaccggtgctcgatttagtgtgagtagttccgcggggctacaacaggcaggcaggggcagcaagatggtgttgcagacccaggtcttcatttctctgttgctctggatctctggtgcctacggggacatcgtgatgacccagtctccagactccctggctgtgcctctgggcgagaggccaccatcaactgcaagtccagccagagtgtttttacagctccaacaataagaactactagctgtaccagcagagccaggacagcctccaagttgctctttacnggcttctacccgggaatccggggtcctgaccgattcagtgcagcggtctgggacngatttcactcgtccacatcaaacngcctgcagctagaagatgtggactacgtttattntagttctgtactaattattacttaactcccccttagtaaccttaggttttacggaccgtaacgggggtaacccgtaaagggttccgggaaaggtaacgttaacggaaaacggtaaccgttaggtaggaacgttacgacccgaacccgtaattaccgtacggtttctttaacccg

SEQ ID NO: 333992 - DNA, 561 bp, Homo sapiens
  misc_feature: GZ8MTXP02HG0QI.44.14.B03.1.454.CMB.2.raw
  modified_base (355)..(355): a, c, t, g, unknown or other
  misc_feature (355)..(355): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacgggacatcgtgatgacccagtctccagactccctggctgtgcctctgggcgagagggccaccatcaactgcaagtccagccagagtgtttttacagctcaacaataagaactactagcttgtaccagcagaagccaggacagcctcctaagtgctctttactggcttctaccggaatccgggtcctgaccgattccagtgcagcggtctgggcngatttcactctcacatcaacagcctgcagacgtgaagaatgtggctactttaatttcttcgtttctagtactaattattacttaccttaccttacgttacgttacgtttacggtacggtaacgggtaacggtaaacggtacggtaagtaacgtaacgtaaaacgtaacgtaggtaacggtacgtacgacactactacgttacgtcg

SEQ ID NO: 333993 - DNA, 569 bp, Homo sapiens
  misc_feature: GZ8MTXP02HBLDV.44.14.B03.1.454.CMB.2.raw
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgtttttacagctaccaacaataagaactacttagcttggtaccagcagaagccaggacagcctacctaagttcgcttcttttacgtgggtcttaccgtacccgggtaactccggggtccctgaccgtattcagtgcaggcggtntgggacngtatttcactcnccacatacaacancctgcagctagaagatgtgctactttattctgtctgactaatattatacctccctagtactagtttcggaccgtacgggtaaccgtaagggtaggaacgaagttacgaaaacggtacgttaggttcggaacgttacgacctaaccgtatccttacggttactttcc

SEQ ID NO: 333994 - DNA, 585 bp, Homo sapiens
  misc_feature: GZ8MTXP02GJ1YX.44.14.B03.1.454.CMB.2.raw
  modified_base (343)..(343): a, c, t, g, unknown or other
  misc_feature (343)..(343): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgaccccagtctccagactccctggctgtgcctctgggcgagagggccaccatcaactgcaagtccagccagagttgtttttacagctccaacaataagaactacttagcttggtaccagcagagccaggacagcctctaagttgcttctttactggtcttcgtaccggaatccggggtcctgaccgtntccagtgcagcggtctgggcagatttcgactctcaccatacaacacgctgcagctagaagtagtgtagctactttatttctgttctgtactattacttactaccttccccttagttactaggttttacgaccggtaacggggtacccgtaaagggttacgggaaagtacgttaacgaaaaacgggtaccgttacggtaaggtaccgttacggacctaacccggtattaccgttcgtttaccc

SEQ ID NO: 333995 - DNA, 492 bp, Homo sapiens
  misc_feature: GZ8MTXP02IPTI3.44.14.B03.1.454.CMB.2.raw
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacgggacatcgtgatgacccagtctccagactccctggctgtgcctctgggcgagagggccaccatcaactgcaagtccagccagagtgtttttacagctccaacaataagaactacttagcttggtaccagcagaagccaggacagcctcctaagttgctcttttacnggcttcgtacccgggaatccgggtcctgaccgattcagtgcngcggtctggacngtnttcactctcacatcaacagcctgcaggctgaagatgtgcatttattctgtctgctatactatactaccctgtactgtttgctagggaccaggtgagatacgaaagactgtagctgcacatcgttctctc

SEQ ID NO: 333996 - DNA, 521 bp, Homo sapiens
  misc_feature: GZ8MTXP02HBGBT.44.14.B03.1.454.CMB.2.raw
  modified_base (364)..(364): a, c, t, g, unknown or other
  misc_feature (364)..(364): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactacttagcttggtaccagcagaagccaggacagcctcctaagttgctctttactggtcttcgtacccgggatccggggtccctgaccgattcacgtgcagcgggtctggacngatttcactctcaccatcaacagccctgcaggctagaagatgtgctactttattctagtctgactaatattactacctcccctgtactagtttcgcgtaggggtacctagggtcgagatacgaaagtactgtcggctgacactatcgtacgtcttac

SEQ ID NO: 333997 - DNA, 526 bp, Homo sapiens
  misc_feature: GZ8MTXP02IOCC5.44.14.B03.1.454.CMB.2.raw
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (505)..(505): a, c, t, g, unknown or other
  misc_feature (505)..(505): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgttttttacagtctaccaacaataaagaactacttagcttggtaccagcagaagccaggacagcctctaagttgctctttactggtcttcgtacccgggaatccgggtccctgaccgattcagtggcagcgggtctgggacngtattcactctccacatcaacngcctgcaggctagaagatgtgactacgtttattctagtctgtactaattacttatacctccctagtactgtttcgacgtagggaccaggtcgagtactacgaacgtactgtagngtcgcacgtatctgtacttac

SEQ ID NO: 333998 - DNA, 713 bp, Homo sapiens
  misc_feature: GZ8MTXP02F13S4.44.14.B03.1.454.CMB.2.raw
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctcgtgggcgagacgggccacatcaactgcaagtccagccagtagttgtttttacagctaccaaacaataaagaactactagcttggaccagcaagaacgccaggacacgcctacctaagttcgtccttacttttacgtcgggtcctttaccgtaaccccggggtaaagttccccgggggttacccctacggacccgtatttccgaagggttcggaccgaacgggtccggggtcgttacggggaactaggttactttccgaaccttcctaccaaccacttaccaaacgaacgcccgtacgacgacggtcgtagaacgtaagtggtcggtacttacgtttatttcgtgttcctagacttaaattattaacttaacccttccccgttacgttaacgttaggttttacggaccggtaacgggggtaacccgtaaaggggtaggtaaacggtaaacgttaacggtaaaagggtaaaccgttggtaacggtccgttacggacctaaccgtacttaccgtttacggttctttaaccg

SEQ ID NO: 333999 - DNA, 525 bp, Homo sapiens
  misc_feature: GZ8MTXP02I0LNB.44.14.B03.1.454.CMB.2.raw
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagtagttgtttttacagctccaacaataagaactactagctggtaccagcagaagcaggacagcctcctaagtgctctttactggtcttccgtacccgggtacgtccgggtccctagaccgattcacgtgcgagcggtcgtgggacngtattcactctcacatcaacngcctgcaggctaganagtgcgtactactttatctgtctgactaattattactacctcctatactagtttacgcgagggtacaggtgagatacaaacggactggacgtcgtacgactaccagtccgtacgtcttacc

SEQ ID NO: 334000 - DNA, 513 bp, Homo sapiens
  misc_feature: GZ8MTXP02HMFPM.44.14.B03.1.454.CMB.2.raw
  modified_base (362)..(362): a, c, t, g, unknown or other
  misc_feature (362)..(362): n is a, c, g, or t
tcagacagtatatacacgaccggtgctcgatttagtgtgagtagttccgcggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagactacttagcttggtaccagcagaagccaggacagcctcctaaagttgctctttactggcttctacccgggaatccggggtcctgaccgattcagtggcagcgggtctgggacngatttcactctcaccatcaacagccctgcaggctgagatgtgcactttattctgtctgcatattatactccctgtactagtttgccgtagggaccaaggttggagtacgtacgaaaacggactagtggcgtcgctacgatctcgttcttac

SEQ ID NO: 334001 - DNA, 512 bp, Homo sapiens
  misc_feature: GZ8MTXP02IS3N5.44.14.B03.1.454.CMB.2.raw
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgtttttacagctccaacaaataagaactacttagcttggtaccagcagaagccaggacagcctcctaagttgctctttactgggccttctacccgggaatcccggggtccctgaccgattcccagtggcagcggtctgggcagtatttcactctcacatcaacngcngcagctgaagntgcgcttactttattctntctnactatattatactcctctacgtagttcgtacgacggacgaaggtaggagatacgaaacgaagtagtgcgtcgcacactctctc

SEQ ID NO: 334002 - DNA, 541 bp, Homo sapiens
  misc_feature: GZ8MTXP02GCD9E.44.14.B03.1.454.CMB.2.raw
  modified_base (364)..(364): a, c, t, g, unknown or other
  misc_feature (364)..(364): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagaggccaccatcaactgcaagtccagccagagttgtttttacagctccaacaataagaactacttagcttggtaccagcagaagccaggacagcctcctagttgctctttactggtcttccgtacccgggatccggggtccctgaccgattcacgtggcagcgggctggacngattcactctcaccatcaacacgcctgcaggctagaacgtatggtgccttaagttttatttcctgtctgactaattattactaccttaccctgttactagtttcggaccgaaggggacctaagggtgaacgtataacgaaaagactggtggctgaccacctagtctagtcctttacg

SEQ ID NO: 334003 - DNA, 666 bp, Homo sapiens
  misc_feature: GZ8MTXP02H04WH.44.14.B03.1.454.CMB.2.raw
  modified_base (450)..(450): a, c, t, g, unknown or other
  misc_feature (450)..(450): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctcgtggggcgaggacgggccaccatcaaactgacaagtccagccagtagttgtttttacagctaccaactaaataagaacttacttagcttaggtaccagacagaagccaggacagcctacctaagtcgccttactttacgtggtcttacgtacccggggtactcccggggtacctacggaccgtattccgaggtggcagggtcggggttcgtggggaccaggttactttaccgaccttccttaccgaaccctaatacccaaacncgtaccctgaccgaggggtcctaggaacgtaagtggttacggtacttaccgttttatttcgtagttcgtagtacctaaattacttaactacccttcccttagtaccgttggtttacggaccgtaacggggtaccgtaaggggtacgtaaagtacgttaaacgaaacggtacgtcggtaacggacttacggactaccgtacgttctttacgttaccc

SEQ ID NO: 334004 - DNA, 524 bp, Homo sapiens
  misc_feature: GZ8MTXP02HQHYY.44.14.B03.1.454.CMB.2.raw
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactactagcttggtaccagcagaagccaggacagcctcctaaagttgctctttactggtcttctacccgggaatccgggtccctgaccgnttcacgtgcagcggtctgggacngtattcactctcacatcaaacagcctgcaggctgaagatgngctatttattctagtctnactatatactcctctatcgttgttcgacgacggtacgtaggagacagtaaacggaaacgtgttaggacgtcgtacgacctacgtcttcgtactttctaaccg

SEQ ID NO: 334005 - DNA, 503 bp, Homo sapiens
  misc_feature: GZ8MTXP02HHBGV.44.14.B03.1.454.CMB.2.raw
  modified_base (486)..(486): a, c, t, g, unknown or other
  misc_feature (486)..(486): n is a, c, g, or t
tcagacagtatatacacgaccggtgctcgatttagtgtgagtagttccgcggggagctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagtgtttttacagctccaacaataagaactactagcttggtaccagcagaagccaggacagcctcctaagttgctctttactgggcttctacccgggaatcccggggtcctgaccgtatccagtgcagcggtctgggcagatttcactctcaccatcaacagcctgcagctgaagatgtgctactttatttctgtctgctaatattatactccctgtactagtttcgccgtagggaccaaggtgacgatacgaaaggactgngctcgcacactctgttc

SEQ ID NO: 334006 - DNA, 728 bp, Homo sapiens
  misc_feature: GZ8MTXP02FMRL4.44.14.B03.1.454.CMB.2.raw
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctcgtgggcgaggacgggcccaccatcaactgacaacgtccagccagtagttgtttttacagtcctaccaacaataagaactactagctacgtaccagacagaacgccgagacacgtcctactaagttcgtcctttacttttacgtcgggtcctttacccggtacccgggtaacggttccccggggtcccctacggtaacccgtattcccgacggtcgggacgacggggtccggggtacggtcggggtacctaggtactttaccaccttcctaccacctactaccaaacgacgtcctgacgtacggggtactaggtaaacgtgttcggtacgtaccttttacggttttactttcgtacggttacctaggtaaccttaaatttaaccgtttaccgttaccccttccccgtttaagttaccggtttacgggttttccgggaacccggttaaggggtaaccgtaagggtacggtaaacgtaacgtaaaccggtaaaaggtaccgttggtaacgtacgtacgaccctaacctcgtacgttactttccg

SEQ ID NO: 334007 - DNA, 569 bp, Homo sapiens
  misc_feature: GZ8MTXP02HDQSA.44.14.B03.1.454.CMB.2.raw
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctcgtgggcgagacgggccaccatcaactgcaagtccagccagagtatttanacacctcaacaatcacactactatcatgtanacaacacagacaggcagcctctaagtnctcatttcnggcatccgaccggtagtccgggcccctgagcatcagtgcgaggtcgggctgggacagacttcactcncacatcagcacnccgtgaccaaaccgtgaaacgtntaggtggtacttaggtttaacttaccgtgtccaagtactaaattagttaacgtacggtacccttaccgtaccgtacctacccgttaccgggacccgaaacgggaccaaccggtaacgtaacggtaagtaaacgttaaaacggtacgtaggtacggtactaacgg

SEQ ID NO: 334008 - DNA, 594 bp, Homo sapiens
  misc_feature: GZ8MTXP02GGLEG.44.14.B03.1.454.CMB.2.raw
  modified_base (401)..(401): a, c, t, g, unknown or other
  misc_feature (401)..(401): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctgatctctggtgcctacgggacatcgtgatgacccagtctccagactccctggctgtgcctctgggcgagagggccaccatcaactgcaagtccagccagagttgtttttacagctccaacaataagaactactagcttgtaccagacagaagccaggacagcctacctaagttgcttctttactgggtcttctacccgggtaatccggggtcccagaccgattccgagtcgcgacgcggtcacgggacaggtactttcgactctcaccagtaccaaacncgcctgacgagctagagtagtgtacgtacttactttagttctcgttcgtagtactaattacttaacgtaccttaccgttagtacttacggtttacggaccgtaacgggtaactagggtacggaacgtacgtaaacgtaaaacggtacgtaggtacgaacgtacgaaccgtactacttcgtacgttacgttacg

SEQ ID NO: 334009 - DNA, 495 bp, Homo sapiens
  misc_feature: GZ8MTXP02I106N.44.14.B03.1.454.CMB.2.raw
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (383)..(384): a, c, t, g, unknown or other
  misc_feature (383)..(384): n is a, c, g, or t
  modified_base (396)..(396): a, c, t, g, unknown or other
  misc_feature (396)..(396): n is a, c, g, or t
  modified_base (451)..(451): a, c, t, g, unknown or other
  misc_feature (451)..(451): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgacccagtctccagactccctggctgtgcctctgggcgagagggccaccatcaactgcaagtccagccagagttgttttttacagctccaacaataagaactacttagcttggtaccagcagaagccaggacagcctctaagttgctctttactggtcttcgtacccgggatccgggtcctgaccgattcacgtgcagcggtntggacngtnttcactctcacntcaacnnctgcaggctganatgtgcatttattctgtctgctatatactctcctgtactgtttgctaggacaggngacatacgaaagtactgtagcgtacgacacagtctacgtcttac

SEQ ID NO: 334010 - DNA, 634 bp, Homo sapiens
  misc_feature: GZ8MTXP02I46HQ.44.14.B03.1.454.CMB.2.raw
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
tcagacagtatatacacgaccggtgctcgatttagtgtgagtagttccgcgggggctacaacaggcaggcaggggcagcaagatggtgttgcagacccaggtcttcatttctctgttgctctggatctatggtgcctacggggacatcgtgatgacccagtctccggactccctggctgtgcctcgtgggcgagagggccaccatcaactgcaagtccagccagagttgtttttacagctaccaacaataagaactacttagcttggtaccagcagaagccaggacacgcctacctaagttgcttcttttacgtggtcttcgtacccgggtagtcccggggtccctcgaccgtattcgaggtcggcaggtcgggtcgtggacngtattccactcctacaccataccaacncgtctcgcagggctagaacgatggtcggtacttacgttttactttcgtcgttctagtactaattactttactaacccttcccccgttagttaaccgtttacggttttccggaccgtaaacgggggtaccctaaggggtacggtaagtaacgtaaacgaaaacgggtactacggttacggtacgtcgtaaccaccgtacgttcgtaccgtttccttacttacccg

SEQ ID NO: 334011 - DNA, 920 bp, Homo sapiens
  misc_feature: GZ8MTXP02H6580.44.14.B03.1.454.CMB.2.raw
tcagacagtatatacacgaccggtgctcgatttagtgtgagtagttccgcgggggagctacaacatgcaggcaggggcagcaagatggtgttgcagacccaggtcttcatttctctgttgctctggatctctggtgccgtacggggacatcgtgatgaccagtctccagacctccctggctgtgcctcgtgggcgagacgggccaaccatacaactgacaacgtccagaccagtagttagtttttacagcctaccaaacaataaacgaactactagtcttacgtaccagacagaacgacaggaacacgccctacgtaaacgtcgtactttacgtttaacgtcggtaccgtttaccggtaacccggggtaaaccgttccccggggttacccctacggtaaccgttaaccgttacccggtaggggttacgggaccggtaacggggtccggggtttaccggtacggggggtaaacccttaagggttaaaccgtttttacccgtaaccccgttaccgtttaacccccaaaacccccgtaaaccgttaaacccgtaaaaaccccgtacccgggcccccttaaggggaacccccgttaggggggtaacccttaagggaaaaaacggtagtttcgggggttaccggttaaacccgttttaacgttttttttaacccttttccgggtttgggtttacccctaggttaacccttaaaatttaaacccgttttaaaccccttacccccgttttaacccccggttagttttaaaacccggttccgggggtttttacccggggaaaacccggaaccggggggttaaacccgaaaacggggtttagggaaacccgtaaacgttaaaaccggaaaaacgggtaccgttaaggtaccggaccgttacggaaccctaaccggtacttcgttacccg

SEQ ID NO: 334012 - DNA, 793 bp, Homo sapiens
  misc_feature: GZ8MTXP02JCP11.44.14.B03.1.454.CMB.2.raw
  modified_base (377)..(377): a, c, t, g, unknown or other
  misc_feature (377)..(377): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagacctccctggctgtcgcctcgtgggcgaggacggccaccatcaactgacaacgtccagcctagtgtttacgtttttacagtcctaccaacaataagtaacttacgtagtcgttacgtaccagacaagacgacagacacgtcctacgtaacgtcgtctttcgtttacgtcggtccgtttaccgtacccgggaaccggttcccgggtccncgtaccgtatcccgagtcggcgacggtcgggtacgtaggacgtacgtacgttccaccttcctaccaacctacttaccaaaccgtcgtacccgtacggaccgtagggtacctaagggtaaagtcgttacgggacggtttacctttaaacggtttttctttacccgtgggtttacccgttagttaaaccgtttaaaacgttacctttaacccttacccccgtttacccgttaacggttttaacccggtttacggggttttaccggggaaccccggggtttaaaccgggggtaaaaccgttaaaccgggggtaacggtaaacgttaacgggtaaaacccgtaaaaggggttcccgtttaggtaaccggtaccgtacgttacccggaaaccttaccgtttaccggtttacctttaccccg

SEQ ID NO: 334013 - DNA, 682 bp, Homo sapiens
  misc_feature: GZ8MTXP02F4IID.44.14.B03.1.454.CMB.2.raw
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
  modified_base (438)..(438): a, c, t, g, unknown or other
  misc_feature (438)..(438): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtgcctctgggcgaggagggccaccatcaactgcaagtccagccagtagttgttttttacagtctaccaaacaataaagaactacttancttaggtaccagcaagaagccgaggacagcctacctaagttntcttcttttacgtgggtcctttccgtaaccccggggtaacgttccccggggtacctcggacccgtacttcccgagtcggcaggcgggtcgtgggacagtactttcacgttcctacaccactacaacncgcctgcgtagctagaagtagtgtacggacttactttttaacgttcgttgttccgtacgtactaaactttaacttacttacccctttccccgttaacgttacttacgggtttttacggacccggtaacgggggtaaccctaaagggggttcggtaaacggtacttaacggaaaaaacgggtccttaagggtccgggtacgtttcgaaccccgtaaccgtacgtttaccttacgggttttacccc

SEQ ID NO: 334014 - DNA, 679 bp, Homo sapiens
  misc_feature: GZ8MTXP02HJQVV.44.14.B03.1.454.CMB.2.raw
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagacctccctggctgtgcctcgtgggcgaggacgggccaccatacaactgacaacgtccagccagtagttgttttacagtcctaccaacaaataagaactactacgcttacggtaccagacaagaacgccagacacgcctacttaagtctcctttactttacgtcggtcctttaccgtaccgggtacgttcccgggtcctacgaccgtattaccgagttcggcgtacggtcgggtacgtacgggactagttactttaccgacctccgtaccaacctaactacccgaaaccacggtccgacggacgtacgggtctaaggaaagtggtgtacgtaccttactttttagttcctaggtttccagtaacttaaattactttaacctaccctcccgttagttaccgttaggtttcggaaccgggtacggggaaccgtaaagggtcgtaaaagtactaaacgggtaaaacgcggttagcgggtactccgtaacgacccttagtcgtttacgtttaccc

SEQ ID NO: 334015 - DNA, 699 bp, Homo sapiens
  misc_feature: GZ8MTXP02IHIOY.44.14.B03.1.454.CMB.2.raw
  modified_base (381)..(381): a, c, t, g, unknown or other
  misc_feature (381)..(381): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgcctacggggacatcgtgatgacccagtctccagactccctggctgtcgcctcgtgggcgaggacgggccaccatcaactgcaacgtccagccagtagttgtttttacagtctaccaactaaataaagaacttactagtcgttagtaccagcagaacgcagacacgcctacgtaagttcgctttaccttttacgtcgggtcctttacccgtacccggggtacgttccccggggtcctcggaccgtnttaccgaggtcgactcgggtcggtcgtgggtacgtagtactttaccgactcctacgaccacttacccaaacgcgtccctggacccgaggctaggaaacgtgtacggtacgtacctttaaatttttcgtttccctaggtttccgttcgtaattaactttaactttaacccggttacccccttacccgttagttaccggtttacgggttttacggaccccgggtaaaagggggtaccgtaggggtaccggtaagtacgtaacggaaaacggttccgttaaggcgtcgtacggacctaaacgtcctttcggtcctttaccg

SEQ ID NO: 334016 - DNA, 741 bp, Homo sapiens
  misc_feature: GZ8MTXP02HTHKG.44.14.B03.1.454.CMB.2.raw
  modified_base (394)..(394): a, c, t, g, unknown or other
  misc_feature (394)..(394): n is a, c, g, or t
tcagacagtatatacacgaccggtgctcgatttagtgtgagtagttccgcgggggagctacaacaggcaggcaggggcagcaagatggtgttgcagacccaggtcttcatttctctgttgctctggatctctggtgccgtacggggacatcgtgatcgaccagtctccagactccctggctgtgcctcgtgggcgaggaggccaccatcaactgacaagtccagccagtagttagttttacacgtctaccaactaaataagaactacttagacgttacgtaccagacagaacgaccgaaggacacgccctacctaagttcgtcttcttttacgtcgggtcctttccgtaacccgggtacgtcccggggtcctcggaccgtatcccgagtcgcgnggtacgggtcgagggctagtacttcgactcctaccacagtaccaaacacgtccctgacgaggtactagaaacgtagtcggtcgtaccttagttttactttcgtcggtttactacggtaacctaaagtttacctttaaaccttaaccccggttccccgttaacggtttaccgtttaacgggtttttacccggggacccgggttaaaacgggggtaaaccccgttaaagggggttaccgggaaaagtaaccggtttaaaaccggaaaacggggtttaaacggttcggggtaaacccggttgacccggttaaccaaacccgtttcgtttaacccgtttacggtttacccc

SEQ ID NO: 334017 - DNA, 750 bp, Homo sapiens
  misc_feature: GZ8MTXP02JCJ5B.44.14.B03.1.454.CMB.2.raw
tcagacagtatatacacgaccggtgctcgatttagtgtgagtagttccgcgggggctacaacaggcaggcaggggcagcaagatggtgttgcagacccaggtcttcatttctctgttgctctggatctctggtgccgtacggggacatcgtgatcgacccagtctccagacctccctggctgtcgcctcgtgggcgaggacgggcccaaccatacaactgacaacgtccagccagtagtttcgtttttacacgtacctaccaaactaaataaagaacttacttagtccttaggtaacccagaccaagaacgaccgaggaccacgtcccttaccgttagttcttctttaccgtttacgtcggtcctttaccggtaaccccggggtacggtccccggggttccctacgtaccgtagtccgtacggtcggaccgacgggtccggggttacgtagggactaggttacctttaccgaccttaccgtacccgtaacctaacgtaccaaccgtaccgtcccgtcgaccgaaggtccgtagacgtacggtcgtacgttatttagttactttagtaacctaaacgttaagtttaacttttaacgaaccttaccgttaacttaccgttacggtttaccgggaacgggtaacgggaccgtaaggtacggtaagacggtaactaaaccggtaaaacgtacgttacgggtacgtccgtaacgtacccaacgttacgtctttacggttaccttactttaccccg

SEQ ID NO: 334018 - DNA, 701 bp, Homo sapiens
  misc_feature: GZ8MTXP02HO60O.44.14.B03.1.454.CMB.2.raw
tcagacagtatatacacgaccggtgctcgatttagtgtgagtagttccgcgggggctacaacaggcaggcaggggcagcaagatggtgttgcagacccaggtcttcatttctctgttgctctggatctctggtgcctacggggacatcgtgatgaccagtctccagactccctggctgtcgcctcgtggggcgaggacgggccaccatacaactgacaagtccagccagtagttgtttttacagtctaccaaactaataaagaactacttagtcttacggtaaccagacaagaacgccgaacggacacgcctacgtaagttcgtcttactttacgtcggtcttaccgtacccgggtaacgttcccggggtaccctacggtaccgtacttacgtacggtacggaccgtagggtccggggttcgtacggggtactacggttactttacctaccgttaccttaccaacctaacttaacccaaaaccgtacgcccgttagaccgacgggtacttaggaaacgtagttcggtacggtacctttacgttttactttcgtcgttactagtaacttaatttacttactaccccttccctagttaacgttacggtttcggaaacggtaacggggaacgtagggtagacgtaaacgtaacgaaaggtactggttacgcttcgaacctactagttaccgtcgtttactaccg

SEQ ID NO: 334019 - DNA, 572 bp, Homo sapiens
  misc_feature: GZ8MTXP01DC5MN.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgcctttggtgattcgctttgagttgggtgcgccagagtccacggaggcctggagtggattggtttaattagaagtaaactctacgtgggacagttgaatcgcctcaatctgtagaaagggcagtatttaccatctcacgagatgatagaaccaaaatactagaccttatacttacaaataggaaactagacctagacggacggacgacgagccgccagatatctcttgttcgttcgacgtactttcgggcgttcggaaccctaaagttcgacgacggttcggggtaacccgggaacttcccgg

SEQ ID NO: 334020 - DNA, 559 bp, Homo sapiens
  misc_feature: GZ8MTXP01B8KA3.39.5.A05.1.454.CMB.2.raw
  modified_base (374)..(374): a, c, t, g, unknown or other
  misc_feature (374)..(374): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgattcgctttgagttgggtgcgccagagtccacgggaggcctggagtggattggtttaattagaagtaaactctacgtggacagttgaatacgcctnaatctgtgaaaggcagatttaccatctcacgagatgatgaaccaaaatctgcctatcttacaaatggaacagcctaggacggacgacgacagcgccagatatctcttgtcgttcgactactttgggccgttgggaacccctaaagttgaacgaacggttcgggggaaccccggttaagttccccg

SEQ ID NO: 334021 - DNA, 555 bp, Homo sapiens
  misc_feature: GZ8MTXP01ADLV2.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgattcgctttgagttgggtgcgcagagtccacggaaggcctggagtggattggtttaattagaagtaaactctacgtggacagttgatacgcctcaatctgtgaaaggcagatttacatctcacgagatgatagaccaaaatactagacctatcttacaaatacggaacagcctagacggacgacgacagcgccagatatctcttgtcgttcgactactttggcgttcggaacccctaaagttcgacgtaacgttcgggggaacccggaacgtcccgg

SEQ ID NO: 334022 - DNA, 670 bp, Homo sapiens
  misc_feature: GZ8MTXP01CNQBJ.39.5.A05.1.454.CMB.2.raw
  modified_base (281)..(281): a, c, t, g, unknown or other
  misc_feature (281)..(281): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactgggtggagtcgtgggggacacgttggcccagccaggccagtccctgacactgtcgtgtaaagcgtctgggttcgcctttggtntattcgtctttgagttgggtgcgccagacgtccgacgggaaggccgtggagtggtatttaggtttaaattaaggaaagttaaaactcgtacggtagggactagttagaaatacgcctcaatctgtagaaaggcagtacttaccatctcacgagatgatacgaaacctaaaatactacgaccttatacttaacaaattacggaaactacggtaccctagggaacgggaaccggaaccgaacgaacggccgacccaaggtaacttacgtccttcgttggttcgttaccgtaaaccgttacggttttcgggccggttaccggtaacccctaaaagtttcggaaacccgtaaccgggttccggggggtaaccccggttaaacgtttccccggg

SEQ ID NO: 334023 - DNA, 628 bp, Homo sapiens
  misc_feature: GZ8MTXP01ECHZF.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgccttggtgattcgctttgagttgggtgcgccagagtccgacgggaagggcctggaggtggtagtttaggtttaaatttaaggaaagttaaaactctaacggtgggactaggttagaatacgcctcaaattctgtagaaagggcagtactttaccatctcacgagatgatacgaaccaaaaatcagacctatcttaacaaatacgggaaactagaccgtaggacggaccgaacgacgacgccggaccaagtactaatcgttcgttggttcgtttacgacttacggttttcgggcgttacggaaccccttaaagttcgaaccgtaacggttccgggggtaaccccggttaagttccccgg

SEQ ID NO: 334024 - DNA, 578 bp, Homo sapiens
  misc_feature: GZ8MTXP01EDHUS.39.5.A05.1.454.CMB.2.raw
  modified_base (304)..(304): a, c, t, g, unknown or other
  misc_feature (304)..(304): n is a, c, g, or t
  modified_base (428)..(428): a, c, t, g, unknown or other
  misc_feature (428)..(428): n is a, c, g, or t
  modified_base (481)..(481): a, c, t, g, unknown or other
  misc_feature (481)..(481): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgattcgctttgagttgggtgcgccagngtccacggaagggcctggagtggatttggtttaaattagaagtaaactctacgtggggacagttgaatacgcctcaatctgtgaaaggcagatttaccatctcacgagatgatgaccaaaatcngctatcttacaaattgggaaacagcctgacggacgacgacagccgccagactntctcttagtcgttcgactacgttttgggccgttcgggcccctaaaagtttcggaacctaacggttcggggggtaaccccgggttaagtttccccggg

SEQ ID NO: 334025 - DNA, 580 bp, Homo sapiens
  misc_feature: GZ8MTXP01EPG27.39.5.A05.1.454.CMB.2.raw
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaacatggaattcggctaaactgggttttctttgtggctatcttggaaggtgtccaatgtgaagtgcaactggtggagtcgtgggggacacttggcccagccaggccagtccctgacactgtcgtgtaaagcgtctgggttcgtcctttggtgtattcgctttgaggttgggtgcgcctagagtccacgggaaggcctggagtggtatttaggtttaaattaagaaagtaaaactctacgtgggactagttgaatacgcctcaatctgtgaaaaggcagtactttaccatctacagagatgaatgaaccaaaaatcnacctatcttaaanaanagaacagacagacggacgacgacgacgcacagtatatctcttgttcgttacgtacgtacgttcggttcgttacgtaacctaacgtaacgtacgtacggttaccgggtaaccggttaacgtcg

SEQ ID NO: 334026 - DNA, 543 bp, Homo sapiens
  misc_feature: GZ8MTXP01D4UNJ.39.5.A05.1.454.CMB.2.raw
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttcttgtggctatcttggaaggtgtccaatgtgaagtgcaactggtggagtcgtgggggacacttggcccagccaggccagtccctgacactgtcgtgtaaagcgtctgggttcgctttggtgattcgcttgagttgggtgcgccagagtccacggaaggcctggagtggattggtttaattaagaagtaaactctacgtggacagttgaatacgctcaatctgtagaaaggcaagtactttaccatctacacgagatgatgaaccaaaaatactagacctatctacaaatggaacagcctagagacggacganagcgccagatatctnttgtgttcgactcgttggcgttacgaacctaatcgacgacggttcgggtccggaacgtcg

SEQ ID NO: 334027 - DNA, 619 bp, Homo sapiens
  misc_feature: GZ8MTXP01EY8PX.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtcgtgggttcgcgtttggtgtattcgtctttggtaggttgggtgcgccgagacgtccgacggggaaggccgtggagtggtagtttaggtttaaattaagtaaagtaaactcgtaacggtagggactagttagaatacgcctcaattctgtagaaagggctagtactttaccattactacacgagtatagatacgaaacctaaaaattctacgtacctatacttaacaaatacggaacagcctagacggacgacacgagccgcagactatctcttgtcgttcgacgtacgtttcgggcgttacggaacccctaaagttcgaacgtaccgggttcgggggtaacccggttaacgttcccgg

SEQ ID NO: 334028 - DNA, 603 bp, Homo sapiens
  misc_feature: GZ8MTXP01DC1TP.39.5.A05.1.454.CMB.2.raw
  modified_base (424)..(424): a, c, t, g, unknown or other
  misc_feature (424)..(424): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtgactatcttggaaggtgtccaatgtgaagtgcaactggtggagtcgtgggggacacttggcccagccaggccagtccctgacactgtcgtgtaaagcgtctgggttcgcctttggtgtattcgctttgagttgggtgcgccagagtccgacgggaagggcctgggagtggtattggtttaaattaagaagttaaaactcgtacgtgggactagttgaatcgcctcaattctgtagaaaggcaagtacttacatctacacganatgatacgaaacctaaaatctacgacttattcttaacaaatcggaaacagacctagggaacggaccggaacgacgacgcgaccagatactctcttggttcttacgtactcgtttcgggcgttacggaacccctaaaagttcgaacgtaccggttcgggggtaaccccggaacgttcccg

SEQ ID NO: 334029 - DNA, 594 bp, Homo sapiens
  misc_feature: GZ8MTXP01BPVS6.39.5.A05.1.454.CMB.2.raw
  modified_base (354)..(354): a, c, t, g, unknown or other
  misc_feature (354)..(354): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaatcggctaaactgggttttctttgtggctatcttggaaggtgtccaatgtgaagtgcaactggtggagtcgtgggggacacttggcccagccaggccagtccctgacactgtcgtgtaaagcgtcgtgggttcgctttggtgtattcgctttgagttgggtgcgccagagtccgacgggaaggccgtggagtggatttggtttaattagaagtaaactntacgtgggacagttgaatacgctcaatctgtagaaaggcagtatttacatctacacgagatgatagaaacctaaaatctcgaccttattcttaacaaatcgggaaacacggcctaggaacggaaccggacgacacggcgccaggactatctcttgtcgttacgacttacgtttgggccgttcgggaacccctaaaagttcgaacgtaaccggttacgggggtccccggttaagttcccgg

SEQ ID NO: 334030 - DNA, 555 bp, Homo sapiens
  misc_feature: GZ8MTXP01BMGGD.39.5.A05.1.454.CMB.2.raw
  modified_base (495)..(495): a, c, t, g, unknown or other
  misc_feature (495)..(495): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttcttttgtggctatcttggaaggtgtccaatgtgaagtgcaactggtggagtcgtgggggacacttggcccagccaggccagtcccctgacactgtcgtgtaaagcgtctgggttcgcctttggtgattcgctttgagttgggtgcgccagagtccacgggaaggcctggagtggattggtttaattagaagtaaaactctacgtgggacagttgaatacgcctcaatctgtgaaaggcagatttaccatctcacgagatgatagaccaaaaatactagcctatcttacaaatgaaacagacctagaggacggacgacgacgcgccagatatctcttgtnttcgactacgtttggcgttggccccaaattcgacgacgttcgggggcccggaagttcccg

SEQ ID NO: 334031 - DNA, 752 bp, Homo sapiens
  misc_feature: GZ8MTXP01CSJNP.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcggctaaactggttttcttgtggctatcttggaaggtgtccaatgtgaagtgcaactggtggagtcgtggggacacgttggcccagccaggccagtccctgacactgtcgtagtaaagcgtcgtgggttcgtccgtttggtgtattcgtcgtttgtagttcgggtgcgcccaggacgtccgaacgggaacggccgtgggagttggtaagtttagggtttaaatttaaggaaacgttaaaacgttcgtaaacggtgggtaactacggttagaaataccgtcctacgaattccgtgtacgaaaggctaaagtactttaaccgatcctacaacgtagtactagtaagtacgaaacctaaaaaacgtcctacgtacccttaacttacttaacgtaaaacgttacggaaaccgtacgtaccgttacgggaacgggtaacccggtaaccggacgaaccggaccgtaaccgtaacgtaacgttaacgtccgttacgttcggttacgttacccgtaccgttaaccgttttcgggaccggttacccggtaaacccgtaaaggtttaaccggaacccggtaaaccgggttcccgggggtaaccccggttaaacgtttccccggg

SEQ ID NO: 334032 - DNA, 557 bp, Homo sapiens
  misc_feature: GZ8MTXP01BKMMJ.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgtattcgctttgagttgggtgcgccagagtccacgggaaggcctggagtggatttggtttaattagaagtaaactctacgtggacagttgaatacgctcaatctgtagaaaggcagtatttaccatctcacgagatgatgaaccaaaatctagcctatcttacaaatggaaacagcctagaggacggacgacagcaccagatatctcttgtgttcgactacgtttggcgttacggaaccctaaagttcgacacggttcggggcccgggttaagttcccgg

SEQ ID NO: 334033 - DNA, 645 bp, Homo sapiens
  misc_feature: GZ8MTXP01ANRP4.39.5.A05.1.454.CMB.2.raw
  modified_base (415)..(415): a, c, t, g, unknown or other
  misc_feature (415)..(415): n is a, c, g, or t
  modified_base (532)..(532): a, c, t, g, unknown or other
  misc_feature (532)..(532): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtcccctgacactgtcgtgtaaagcgtcgtgggttcgtcgttggtgtattcgctttgaggttgggtcgcgccagacgtccgacggggaacggccgtgggaggttgggtagtttagggtttaaatttaaggtaaaagttaaaaccttcgtaacggtggggaactaggttagaatacgcctnaattctgtagaaaggcagtacttacatactcacgagatgatagaaccaaaatctagaccttatacttacaaatagaactagccgtaggacggacgacgacgaacgcgaccagtactntctcgttggttcgttaccgtaacgttcgtttcgggccggttacggaacccctaaagtttccggaaaccggtaccgggttaccgggggtaaccccgggttaactttccccgggg

SEQ ID NO: 334034 - DNA, 587 bp, Homo sapiens
  misc_feature: GZ8MTXP01DUUGO.39.5.A05.1.454.CMB.2.raw
  modified_base (516)..(516): a, c, t, g, unknown or other
  misc_feature (516)..(516): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgtccgtttggtgtattcgctttgaggttgggtgcgccagagtccacgggaaggccgtgggagtggtatttaggtttaaattaagaaagttaaaactcgtaacggtggggaactaggttagaaatacgcctcaatctgtagaaaggcagtattaccatctcacgagatgatagaaccaaaaatctagacctatactaacaaagtggaaacagcctaggaggaacgacgacgacgccgccagatatctnttgtcgttcgactcgtttggcgttcgaaccctaagttcgaacgacgttcgggggtccccgttaagttcccg

SEQ ID NO: 334035 - DNA, 679 bp, Homo sapiens
  misc_feature: GZ8MTXP01APEOF.39.5.A05.1.454.CMB.2.raw
  modified_base (270)..(270): a, c, t, g, unknown or other
  misc_feature (270)..(270): n is a, c, g, or t
  modified_base (450)..(450): a, c, t, g, unknown or other
  misc_feature (450)..(450): n is a, c, g, or t
  modified_base (488)..(488): a, c, t, g, unknown or other
  misc_feature (488)..(488): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacacgtgtcgtgtaagcgtctgggttcncgtttggtgtattcgctttggaggttgggtgcgccgagacgtccgacgggaacgggccgtaggggaggtggtagtttaggtttaaattaaggtaaacgttaaaactcgtaacggtgggaactaggttagaaataccgcctcaattcgtgtagaaaggcagtactttaccatctacacganatagatacgaacaaaagtctagtaccttattacctaanaaacgtcggaaacacggtaccgtagggaaccggaacgggacgaaccgacggcgacccgtaagtactaacgttctacgttcggttacgttccgtaacgttcgtttcgggcccggttacggtaacccctaaagtttaacggaaacccggtaacgggttcccggggggtaaccccggttaacgttttccccggg

SEQ ID NO: 334036 - DNA, 612 bp, Homo sapiens
  misc_feature: GZ8MTXP01B5KZH.39.5.A05.1.454.CMB.2.raw
tcagtcgcactagtcacgaccggtgctcgatttagatagatagacaggggaggtctgggagaggagccccagccgtgagattcccaggagtatccacctggagatcagcactaaacacagaccaccaaccatggaattcgggctaaactgggttttctttgtggctatcttggaaggtgtccaatgtgaagtgcaactggtggagtcgtgggggacacttggcccagccaggccagtccctgacactgtcgtagtaaagcgtctggggttcgtccgtttggtgtatttcgctttggaggttgggtgcgccagagtccgacggaagggcctggagtggtatttaggtttaataagaaagttaaaactcgtaacgtgggactagttacgaatacgcctcatctgtgaaaggcagtatttaccatctacacgagatagatagaaccaaaaatctagtacctattacttacaaatacgaacacgtaccgtagaacggacggacgacgacggaccgaccaagtactactcttcgtgttcgttcgactacgtttcggcgttcggacccctaaagttcgaacgtaccggtacggggacccggtaacgttcccggttcgg

SEQ ID NO: 334037 - DNA, 632 bp, Homo sapiens
  misc_feature: GZ8MTXP01CQEF6.39.5.A05.1.454.CMB.2.raw
  modified_base (453)..(453): a, c, t, g, unknown or other
  misc_feature (453)..(453): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
tcagtcgcactagtcacgaccggtgctcgatttagatagatagacagggggaggtctgggagaggagccccagccgtgagattcccaggagtatccacctggagatcagcactgaacacagaccaccaaccatggaattcgggctaaacttgggttttctttgtggctatcttggaaggtgtccaatgtgaagtgcaactggtggagtcgtgggggactacgttcggcccagccaggccacgtccctgacactgtcgtagtaaagcgtcgtgggttcgtccgtttggtgtattcgtctttggtaggttgggtgcgccgagacgtccgacggggagggccgtgggaggtggtagtttaggtttaaatttaaggtaaagttaaaactcgtaacggtgggactaggttagaactcgcctcaattcgtgtagaaagctagtattaccatctcacganatgatacgaaactaaaatactcgtaccttatacttacaaatacgaacacgtcctaggaacggaccgacgacgacgcgtaccgagtactntctnttggttcttcgtaacttcgtttcggcgttacggaaccctaagttccgaacgtacgggttaccggggtaacccgttaacgttcccgg

SEQ ID NO: 334038 - DNA, 608 bp, Homo sapiens
  misc_feature: GZ8MTXP01ERA2W.39.5.A05.1.454.CMB.2.raw
  modified_base (541)..(541): a, c, t, g, unknown or other
  misc_feature (541)..(541): n is a, c, g, or t
tcagtcgcactagtcacgaccggtgctcgattttagatagatagacagggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtcgtgggttcgctatttggtgatttcgctttggagttgggtgcgtccagagtcccgaacgggaagggcctgggagtgggtagtttagggttttaaattaaggaaagttaaaactcgtaacggtgggacctaggtttagaaagtacgcctacatcgtgtagaaagcaagtactttacatctacacgagatgatacgaactaaaatctcgaccttatacttacaaagtacgaaacacgacctaggacggacggaacgacgacgcgaccaagactaatcttntcgttgttccgacttacgtttcggcgtcggaccctaagttcgacgttacggtcggggccggtaaccg

SEQ ID NO: 334039 - DNA, 623 bp, Homo sapiens
  misc_feature: GZ8MTXP01CMZ1W.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggactacgttggccccagccaggcccagtcccctgacactgtcgtgtaagcgtctgggttcgtcctttggtgtattcgctttggagttgggtgcgccaggacgtccgacggggaaggcctgggagtggatttggtttaaattagaagtaaactcgtacgtggactagttgatacgcctcaattctgtgaaaggcagtactttaccatcctcacgagatgatacgaacctaaaaagtctacgaccttattccttaacaaatggaacagcctaggaacgggaccggacgacgacgccgccagtactactccgttcgttggttcgttccgtaaccttcgttttacggggccgttacgggtaacccctaaagttcgaaccgtacgggttcgggggtaaccccggttaagttcccgg

SEQ ID NO: 334040 - DNA, 681 bp, Homo sapiens
  misc_feature: GZ8MTXP01C300K.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacgttggcccagccaggccagtccctgacactgtcgtgtaaagcgtctggttcgtcctttggtgtattcgctttggagtttgggtgcgccaggacgtcccgaacggggaagggcctggggaggttggtagtttggttttaaattaagaaagttaaaacttcgtaacggtgggactagttagaactacgccctcaattcttggtagaaagggctaagtactttaccatcctacacgtagatgaattagaacctaaaaatctacgtaccttaatacttaactaaacttagggaaacctacgacccgtagggaacggaaccgggtaaccgaacgaacggccgtacccgaggtaataactctacgttcgttacggttaccgtaccttacgtttcgggccggttaccggtaacccctaaagttcgaaccgtacggttaccggggggtccccgggttaacgtttccccggg

SEQ ID NO: 334041 - DNA, 617 bp, Homo sapiens
  misc_feature: GZ8MTXP01AR75L.39.5.A05.1.454.CMB.2.raw
  modified_base (397)..(397): a, c, t, g, unknown or other
  misc_feature (397)..(397): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttcttgtggctatcttggaaggtgtccaatgtgaagtgcaacgtggtggagtcgtgggggacacgttcggcccagccaggccagtccctgacactgtcgtagtaagcgtcgtgggttcgtcgtttggtgtattcgctttgtaggttggtgcgccgaggacgtccgacggggaaggccgtggagtggtatttaggtttaaataagtaaagtaaactcgtaggtggactagttagaactcgcctnaatctgtagaaagcagtactttaccatctacacgagtagtagtatagaaacctaaaatctacgtaccttatacttaacaaatacggaacgacgaccgtagggacggaaccggacgacgacgaccaacagtacttctctcgttgtcgttacgtactacgttcggcgttcgtaaccctaagtccgaaccgtacggttcggggtaacccgttaacgttcccgg

SEQ ID NO: 334042 - DNA, 596 bp, Homo sapiens
  misc_feature: GZ8MTXP01CFK9G.39.5.A05.1.454.CMB.2.raw
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
  modified_base (500)..(500): a, c, t, g, unknown or other
  misc_feature (500)..(500): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgtccttggtgtattcgctttgagttgggtgccgccaggagtcccgagggaaggcctggagtggatttggtttaaattagaagtaaaactgtacggtggactagttgaatcgcctnaatctgtagaaaggctagatttaccgatctanacgagtatgaatcgaaacctaaaaatctgtacctatcttacaaagtaggaaacagtccgtaggaacggtagacggaacgaacgngtaccgccgaagataactcttagtgttcgttacgtattacgtttgggcgtcggaccctaagttcgaaccggttacggtcgggggaacccgttaacg

SEQ ID NO: 334043 - DNA, 657 bp, Homo sapiens
  misc_feature: GZ8MTXP01DK7BE.39.5.A05.1.454.CMB.2.raw
  modified_base (398)..(398): a, c, t, g, unknown or other
  misc_feature (398)..(398): n is a, c, g, or t
  modified_base (469)..(469): a, c, t, g, unknown or other
  misc_feature (469)..(469): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggtttttctttgtggctatcttggaaggtgtccaatgtgaagtgcaactggtggagtcgtgggggacacgttggcccagccaggccagtccctgacactgtcgtgtaaagcgtcgtgggttcgcctttggtgtattcgctttggagttgggtgcgccgagagtccgacgggaggccgtggagtggtattggtttaattagaagtaaactctacgtggacagttgaatacgcctcaatctgtgaaaggnagtactttaccatctacacgagtatgatagaaccaaaaatactcgacctatacttaacaaatacggaaacncgacccgtagggaacggacggaaccgacgaacgacccaaaccgtaaggtaactacttccgttacgttcggttacgtttccgtaaaccgtttcggtttacggggttccggttaccggtaacccctaaaagtttcggaaaccggttaacgggttcccgggggtaaccccggggttaaacgtttccccggg

SEQ ID NO: 334044 - DNA, 582 bp, Homo sapiens
  misc_feature: GZ8MTXP01B2MTH.39.5.A05.1.454.CMB.2.raw
  modified_base (469)..(469): a, c, t, g, unknown or other
  misc_feature (469)..(469): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtcccctgacactgtcgtgtaaagcgtctgggttcgcctttggtgattcgctttgagttgggtgcgccagagtcccacggagggcctggagtggattggtttaattagaagtaaactctacgtgggacagttgaatacgcctcaatctgtgaaaggcagtatttaccatctcacgagatgatgaccaaaatactacgacctatcttacaaatggaacagcctagaggacgacganacgcgcagatatctcttgtcgttcgtaacgtcgtttgggttccgttcgggaacccctaaagtttcggaaccgtaacggttaccgggggtccccggggaacgtttcccccgggg

SEQ ID NO: 334045 - DNA, 676 bp, Homo sapiens
  misc_feature: GZ8MTXP01EXKBV.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaacgtggtggagtcgtgggggacacgttggcccagccgaggccacgtccctgacactgtcgtgtaagcgtcgtgggttctccgtttggtgtattcgcgtttggaggttggggtgtccgccgaaggtacggtaccccgaacggggaacgggcccgtaggggaggttggtaagtttttagggtttaaattaaggtaaaagttaaaacgttcgtaacgggtagggactagttagaaatccgctacaatctggtagaaaggcagtacttacagtcctacgacgagtatggaactagaaacctaaaaaagttctacgaccttaacttacttaacaaagtacgaaacgacgtacccgtaggaaccgggacggaaccgacgaacgaccgcctaagactatccgttattcggtacgtttacgacttacggttcggttcgttacggaaccctaagtcgaacgacggttcgggaacccggttaagttcccgg

SEQ ID NO: 334046 - DNA, 607 bp, Homo sapiens
  misc_feature: GZ8MTXP01E31HR.39.5.A05.1.454.CMB.2.raw
  modified_base (385)..(385): a, c, t, g, unknown or other
  misc_feature (385)..(385): n is a, c, g, or t
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactggttttctttgtggctatcttggaaggtgtccaatgtgaagtgcaactggtggagtcgtgggggacacgttggcccagccaggccagtccctgacactgtcgtagtaaagcgtcgtgggttcgtccgtttggtgtattcgctttgagttggtgcgccagagtccgacggaggccgtggagtggatttggtttaataagaagtaaactcgtacggtggactagttagaatacgcctnaactctgtagaaagcagtatttacatctcaaganagtgatgaaaccaaaatcngacctataccttaanaaattcgggaaacagcccgtaggacgaaccggacgaacgacgccgtaccagtactactctacgttgtcgttaccgactcgtttcgggccgttacggaacccctaaagttcgaacccgtaacgggttcgggggtaaccccggttaattccccggg

SEQ ID NO: 334047 - DNA, 613 bp, Homo sapiens
  misc_feature: GZ8MTXP01BGCZM.39.5.A05.1.454.CMB.2.raw
  modified_base (303)..(303): a, c, t, g, unknown or other
  misc_feature (303)..(303): n is a, c, g, or t
  modified_base (464)..(464): a, c, t, g, unknown or other
  misc_feature (464)..(464): n is a, c, g, or t
tcagtcgcactagtcacgaccggtgctcgatttagatagatagacaggggaggtctgggagaggagccccagccgtgagattcccaggagtatccacctggagatcagcactaaacacagaccaccaaccatggaattcggctaaactgggttttctttgtggctatcttggaaggtgtccaatgtgaagtgcaactggtggagtcgtgggggacacttggcccagccaggccagtccctgacactgtcgtgtaaagcgtctgggttcgtccgtttggtgtatttcgctttggaggtttgggngtcgccaggagtccgacggaagggcctgggagtgggtaatttagggtttaaagtaagtaaagttaaaactcgttaacgtagggactaggttagaatacgtcctcatctaggtgaaagcagtactttaccatctacacgagatgatagaactaaaatactancctaattactacaaagtcgaacagaccgtagacggacggacgacgagcgccagtactatctaactgttcgtacagtaccgtttgggcgttcgggaccctaaagttcgaacgtaacggtcgggggacccggtaacgttcccgtttccggg

SEQ ID NO: 334048 - DNA, 624 bp, Homo sapiens
  misc_feature: GZ8MTXP01A4TMV.39.5.A05.1.454.CMB.2.raw
  modified_base (309)..(309): a, c, t, g, unknown or other
  misc_feature (309)..(309): n is a, c, g, or t
  modified_base (545)..(545): a, c, t, g, unknown or other
  misc_feature (545)..(545): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttcttgtggctatcttggaaggtgtccaatgtgaagtgcaactggtggagtcgtgggggacacttggcccagccaggccagtccctgacactgtcgtgtaagcgtctgggttcgccgtttggtgtattcgctttggagttggggtgcgccgtagngtcccgacgggaagggcctggagtggtatttggtttaaatagaaagtaaaactcgtacggtgggactagttagaatcgcctcaactctgtagaaacggcagtatttacccatctacagagatagattacgaacccaaaattcctagtaccctattacctttaccgaaattcgggaaactacggtacccagggaaacggaccggaaccgacgagccgtacccaaggtactatccctnttgttacgttcgaactgtttcggcgttacggccctaaagttcggaactaacggcgggggaacccgttaacgtttcccgg

SEQ ID NO: 334049 - DNA, 644 bp, Homo sapiens
  misc_feature: GZ8MTXP01ANKUZ.39.5.A05.1.454.CMB.2.raw
  modified_base (397)..(397): a, c, t, g, unknown or other
  misc_feature (397)..(397): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtcccctgacactgtcgtgtaaagcgttctgggttcgtccgtttggtgtattcgctttggagttgggtgcgccagacgtccgacgggaagggcctggagtggtatttaggtttaaattaagaaagttaaaactcgtacggtgggactagttagaatcgcctnaatcgtgtgaaaggcagtacttaccatctacacgagatgattacgaactaaaatctacgacctaattctaactaaattcggaaactacgtaccgtaggaacgggaaccggaccgaacgacgaccggaccaggtaactctaacttcgttggttcgttccgtaacttacgtttcgggccgtttaccgggaacccctaaagtttcgaaccgtacgggttaccgggggtaacccggttaacgtttccccgg

SEQ ID NO: 334050 - DNA, 593 bp, Homo sapiens
  misc_feature: GZ8MTXP01DF1YX.39.5.A05.1.454.CMB.2.raw
  modified_base (369)..(369): a, c, t, g, unknown or other
  misc_feature (369)..(369): n is a, c, g, or t
  modified_base (471)..(471): a, c, t, g, unknown or other
  misc_feature (471)..(471): n is a, c, g, or t
  modified_base (500)..(500): a, c, t, g, unknown or other
  misc_feature (500)..(500): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccacgtccctgacactgtcgtgtaaagcgtcgtgggttcgtccgtttggtgtattcgctttggaggttgggtgcgccaggacgtccgacgggaaggcctagggagtggtatttaggtttaattaagaaagtaaactntacgtggactagttgaatcgctcaatctgtagaaaggcaagtacttacatctacacgagatgatagaacctaaaatctgaccttatcttaacaataggaacngactggaacggacggacacgacgcacagntacttctacttgtcgttcgtaacgtcttttaggccgttacgtaaccctaaagttcgaacgtacgggttcgggggtaacccgttaacgttccgg

SEQ ID NO: 334051 - DNA, 636 bp, Homo sapiens
  misc_feature: GZ8MTXP01B5S4E.39.5.A05.1.454.CMB.2.raw
  modified_base (412)..(412): a, c, t, g, unknown or other
  misc_feature (412)..(412): n is a, c, g, or t
  modified_base (490)..(490): a, c, t, g, unknown or other
  misc_feature (490)..(490): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactgggtggagtcgtgggggacacgttggcccagccaggccagtccctgacactgtcgtgtaaagcgtcgtgggttcgcgtttggtgtattcgtctttggagttgggtgcgtccagacgtccgacgggaacgggccgtgggagtgggtagtttaggttttaaattaaggtaaagttaaaacgttcgttaacggtagggactagttagaatacgcctnaatctgtagaaagctagtattacactctcacgagatgaacttgaaacctaaaatcctacgacccttattaccttaaanaaatacgaacgacgtacgtaggaacggacgaacgacgacgccgacaatactctcgtcgttgttcgttacgtacgttacggttcgggccgttaccggtaaacctagtaaccgaacgtaccgggttccggggtaacccgttcgttccg

SEQ ID NO: 334052 - DNA, 577 bp, Homo sapiens
  misc_feature: GZ8MTXP01BNTGE.39.5.A05.1.454.CMB.2.raw
  modified_base (302)..(302): a, c, t, g, unknown or other
  misc_feature (302)..(302): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgattcgcttgagttggtgcgccagngtccaggaaggcctgggagtggattggtttaaattagaagtaaaactctacgtggacagttgaatacgctcaaatctgtgaaagcagatttacatctcacgagatgatagacctaaaaatctgcctatcttacaaattcggaaacagcctagaaggacgacgacaagctaccagatatctcttgtcgttcgactaacttttgggcgttacgggaacccctaaaagtttcggaaccgaacggttaccgggggtccccggggttaaatttccccggg

SEQ ID NO: 334053 - DNA, 713 bp, Homo sapiens
  misc_feature: GZ8MTXP01ENW6W.39.5.A05.1.454.CMB.2.raw
  modified_base (523)..(523): a, c, t, g, unknown or other
  misc_feature (523)..(523): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcggctaaactggttttctttgtggctatcttggaaggtgtccaatgtgaagtgcaacgtggtggagtcgtgggggacacgttcggcccagcccgaggcccacgtcccctgacactgtcgtagtaaagcgttcgtggttcgcgtttggtgtacttcgtcgtttggtaggttgggtgccgaccgaggtacgtaccccggacggggtaacgggccgtagggtaggttaggtaagttttagggtttaaacgtttaaaggtaaacgttaaaaacgttccgttaacgggtaagggtacctaaggtttaggaaactaccggcccttacaaattccgtggtaagggaaacgcgtagttaaactttacccattcctacgacgtagagtagtaanacgaaaactaaaattccgtcgtaccttactacttaaacaaagttcgggaaacacggtctaagggaacggacggaaccgacgagccggtacaagtctaagtctacgttgtcgttcgaaactttcccggttaggccgttacgaacctaaagttcgaaccggtacggttcggggtaacccgttaattcccggg

SEQ ID NO: 334054 - DNA, 702 bp, Homo sapiens
  misc_feature: GZ8MTXP01A9SPY.39.5.A05.1.454.CMB.2.raw
  modified_base (478)..(478): a, c, t, g, unknown or other
  misc_feature (478)..(478): n is a, c, g, or t
  modified_base (515)..(515): a, c, t, g, unknown or other
  misc_feature (515)..(515): n is a, c, g, or t
tcagtcgcactagtcacgaccggtgctcgatttagatagatagacaggggaggtctgggagaggagccccagccgtgagattcccaggagtatccacctggagatcagcactaaacacagaccaccaaccatggaattcgggctaaacttgggttttctttgtggctatcttggaaggtgtccaatgtgaagtgcaacgtggtggagtcgtgggggacacttggcccagccaggccagtccctgacactgtcgtagtaagcgtcgtggggttcgtccgtttggtgtatttcgcttttggaggtttggggtgccggccgaaggtacggtccccgaaacggggaaacggggtcccgtaggggaggtgggtagtttagggttttaaattaaggtaaaagttaaaacctcgttaacggtggggactaaggttacgaatacgccctacatactgtgaaagcagtactttaccatctacacganatgatacgaacctaaaaatctacgtacctatcttaanaaattacgaaacacgtccgtaggaacgggaccgaaccgacgacggaccgccgtaagtatactctcgttcggttacgtaccgttacgttaacggtttcgggttccggttaccggttaccccgttaaaagttccggaaccgtaacgggggttccgggggacccggttaaccgtttccggttaacccggg

SEQ ID NO: 334055 - DNA, 665 bp, Homo sapiens
  misc_feature: GZ8MTXP01C3X1B.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaagcgtcgtgggttcgcctttggtgattcgctttggtagttgggtgcgccagagtccacgggaaggtcctgggagtggtagtttggtttaaattagaagttaaactcgtaacggtggtactagttagaatacgccctctaactctgtagaaagctagtactttaccgattctccaaggtacgatagattacgaaacctaaaaagttcctacggtaccttaacttacttaactaaacgttacggaaacgtacggtaccgttacggaaggggaaccggacgaaccaacggaccggtccaagtactattctaccgttgttcggttcgtaccgtaacgtttcgggccggttacggaaccccgttaaagtcgtaacgtacggttacgggggtaacccgggaaacgttttccccggg

SEQ ID NO: 334056 - DNA, 660 bp, Homo sapiens
  misc_feature: GZ8MTXP01D3C7X.39.5.A05.1.454.CMB.2.raw
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgcctttggtgtattcgcgtttgagttgggtgcgccagagtccgaggaaggctggagtgatttggttaatagaagtaaactntagtggactagtanaatacgcctanaattctgtagaaagggtcagtactttacgatcctacacgagatagatacgaaacctaaaaattactacgtaccttattaccttaactaaaacttacggaaaactacggtacccgttaaggaacggggaaacggaaccgaacgtaacggccgtaccccgaaagtacttaacgtaactcgttaggttcgtttaccgaaacttacggtttcgggcgttaccgggtaacccgtaaaagttcggtaaaccgaaaccggttcgggggaaccccggttaaagtttccccggg

SEQ ID NO: 334057 - DNA, 617 bp, Homo sapiens
  misc_feature: GZ8MTXP01A8T8C.39.5.A05.1.454.CMB.2.raw
  modified_base (297)..(297): a, c, t, g, unknown or other
  misc_feature (297)..(297): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgccttggtgtattcgctttgagttgggngtcgccagagtccgacgggaaggcctgggagtggatttggtttaattagaagtaaaactctacggtggactacgttagaatacgcctnaatctgtagaaaggcagtatttaccatctnacgagatgattacgaactaaaaacgtctacgaccctattccttacaaaatacgggtaaacacgtcccgtaggaacgggaccggaacgacacggcgaccagatacgtaactcgttgttcgttcgacttacgtttcgggccgttacgggaacccctaaagttcgaaccgtaccggttacggggtaacccggttaacgttcccgg

SEQ ID NO: 334058 - DNA, 681 bp, Homo sapiens
  misc_feature: GZ8MTXP01COFGF.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaagtgtccaatgtgaagtgcaactggtggagtcgtgggggacacttggcccagccaggccagtccctgacactgtcgtgtaaagcgtctggttcgcctttggtgtattcgctttgagttgggtgccgccagacgtccgaacgggtaacgggccgtaggaggttaggtagtttaggtttaaaatttaagaaaagttaaaactcgtaacgtggactacgttgaaatcgcctcaattcgtgtagaaaggcaagtacttaccatcctacaacgagatgaatagaaacctaaaaagtactacgaccttaatcctaataaacgacgtaaacaacgtccctagggaaacggaaccgaacggacaacgggaccgtacccgaagtaaactcttccctagttcgggttacgttcgtaaacccgttaacgtttcggggttccgttaccgggtaacccctaaaagtttcggaaaccggtaaccgggttccgggggaaccccgggttaaacgtttccccgg

SEQ ID NO: 334059 - DNA, 666 bp, Homo sapiens
  misc_feature: GZ8MTXP01E5FQI.39.5.A05.1.454.CMB.2.raw
  modified_base (282)..(282): a, c, t, g, unknown or other
  misc_feature (282)..(282): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (465)..(465): a, c, t, g, unknown or other
  misc_feature (465)..(465): n is a, c, g, or t
tcagtcgcactagtcacgaccggtgctcgatttagatagatagacagggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtgagtcgtgggggacacttggcccagccaggccagtccctgacactgtcgtagtaaagcgtcgtgggttcgtcctttggtntattcgctttgagttgggtcgcgcagacgtccgacgggaaggcctggagtggtattaggtttaattaagaaagtaaactcgtacggtggactagttagaatacgcctnaatctgtagaaaggcagtattaccatctanacganatgaatagaaaccaaaaagtctcaccctattccgttaaanaaatacggaacacgaccgtaggaacgggaaccggacgtaacgacgccgaactaagtacttacttccgttacgtttacggtaccgtttaccgtaaccgtttacgggtttaccgggaccgttaaccggtaaaccccttaaaggttaaccggaaaccggtaacccggggttacccgggggtaaccccgggttaacgttccccgg

SEQ ID NO: 334060 - DNA, 625 bp, Homo sapiens
  misc_feature: GZ8MTXP01BZDW1.39.5.A05.1.454.CMB.2.raw
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
tcagtcgcactagtcacgaccggtgctcgatttagatagatagacaggggaggtctgggagaggagccccagccgtgagattcccaggagtatccacctggagatcagcactgaacacagacccaccaaccatggaattcgggctaaactgggttttctttgtggctatcttggaaggtgtccaatgtgaagtgcaactggtggagtcgtgggggacacgttcggcccagccaggccagtcccctgacactgtcgtagtaagcgtcgtgggttcgtcgtttggtgtattcgctttggaggttgggtgcgccagacgtccgacgggaaggcctgggagtggtatttggtttaatagaaagtaaactntacggtggactagttnatcgcctnaatcgtgtagaaaggcagtactttacatctacacgagatagatacgaaacctaaaaatctacgtaccttattaccttaacaaagttacggaactacgaccgtaggaacggacggacgacgacggccgaccgagactactcgttcgttggttcgttcgtacgttcgtttcgggcgttacggtaaccctaaagttccgaacgtacgggttaccgggggtcccggttaacgttcccgg

SEQ ID NO: 334061 - DNA, 746 bp, Homo sapiens
  misc_feature: GZ8MTXP01CM9IM.39.5.A05.1.454.CMB.2.raw
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
tcagtcgcactagtcacgaccggtgctcgattttagatagatagacaggggaggtctgggagaggagccccagccgtgagattcccaggagtatccacctggagatcagcactgaacacagaccaccaaccatggaattcgggctaaacttgggttttctttgtggctatcttggaaggtgtccaatgtgaagtgacaactgggtggagtcggtggggggactacgttcggcccaggccgacggcccacgtcccctgaccactgtcgtgtaaagcgttcgtgggttcgtcgtttggtgtnttcgcgtttggnggttgggtgccgccaggacgtaccgacggggacggtccgtggaggtggtagtttaggtttaattaagaaacgttaaactcgtacggtgggactaggttagaacgtccgacctctaaagttccgtggtaggaaacggtcgtaagtactttaccagtacctacgaacgagtacgtagtaactaggaaacctaaaacgttctacggttaccttacttacgtttaactaaacgtaacggtaacgtacgggtaccgttacggggaaccggggtaaaccgggaccgaacggaccggcccgtaaccgtagtaacttacgttcccttggttcggtttacgttccgttaacgttcggtttacgggccggttccggtaacccgtaaacgttcgggaacccgtacggggttaccgggggtaaccccgggttaagtttccccgggg

SEQ ID NO: 334062 - DNA, 573 bp, Homo sapiens
  misc_feature: GZ8MTXP02GNSQM.39.5.A05.1.454.CMB.2.raw
  modified_base (384)..(384): a, c, t, g, unknown or other
  misc_feature (384)..(384): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgtatttcgctttggagttgggtgcgccagagtccacggaagggcctggagtggattggtttaatagaagtaaaactctagtggacagttgaatacgcctcatctgtnaaaggcagatttaccatctacacgagatgatgaccaaaaatctgccctatcttacaaatgaaactagcctaggacggaacggacgacagccgaccagatatctactggtcgttacgacttaccgtttggcggttcggaacccctaaaagttcggaaaccaacggtcgggggacccccggtaattcccgg

SEQ ID NO: 334063 - DNA, 552 bp, Homo sapiens
  misc_feature: GZ8MTXP02JSBV3.39.5.A05.1.454.CMB.2.raw
  modified_base (379)..(379): a, c, t, g, unknown or other
  misc_feature (379)..(379): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccagagtccacgggaagggcctggagtggattggtttaattagaagtaaaactctacgtgggacagttgaatacgcctnatctgtagaaaggcagatttaccatctcacgagatgatgaccaaaatctagcctatcttacaaatagaacagacctgaggacgacgaacaggcgccagatatctctgtcgttcgactacgtttcggcgttggaaccctaaattcgacaacgtccggggacccggaattcccgg

SEQ ID NO: 334064 - DNA, 565 bp, Homo sapiens
  misc_feature: GZ8MTXP02JMKWH.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgtatttcgctttgagttgggtgcgccagagtccacgggaagggcctggagtggtattgggtttaataggaagttaaaactcgtacgtggggacagttgaatacgcctcatctgtgaaaggcagtatttaccatctcacgagatgatgaccaaaatctgacctatacttacaaatgaaacagcctaggaacggacggacgacagcgaccagatatctctgtcgttcgactacgtttggccgtggaacccaaagttcgaacgtaacgtcgggggaccccggaattcccgg

SEQ ID NO: 334065 - DNA, 548 bp, Homo sapiens
  misc_feature: GZ8MTXP02G3H75.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgcctttggtgtatttcgctttgagttgggtgcgccagagtccacggaagggcctggagtggattggtttaattagaagtaaactctacgtggacagttgaatacgcctcatctgtgaaaggcagatttaccatctcacgagatgatgaccaaaatctagcctatctacaaatgaacagcctagagacgacgacagcgcagatactctctgtcttcgactacgtttcggcgttggaacccctaaaagttcgaacaacggtcggggacccggtaatcccgg

SEQ ID NO: 334066 - DNA, 558 bp, Homo sapiens
  misc_feature: GZ8MTXP02F5685.39.5.A05.1.454.CMB.2.raw
  modified_base (378)..(378): a, c, t, g, unknown or other
  misc_feature (378)..(378): n is a, c, g, or t
  modified_base (409)..(409): a, c, t, g, unknown or other
  misc_feature (409)..(409): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtcccctgacactgtcgtgtaaagcgtctgggttcgcctttggtgatttcgctttgagttgggtgcgccagagtccacgggaaggcctggagtggattggtttaattagaagtaaaactctacgtgggacagttgaatacgctnatctgtgaaaggcagatttacatctcacganatgatgaccaaaaatctgacctatcttacaaatgaacagacctagagacggacgacgacgcgccagatatctcgtgtcgttcgtactacgttcggcgttcggaaccctaaacgttacgacgaacgtacgggggacccgggaacttcccg

SEQ ID NO: 334067 - DNA, 563 bp, Homo sapiens
  misc_feature: GZ8MTXP02JNE5V.39.5.A05.1.454.CMB.2.raw
  modified_base (378)..(378): a, c, t, g, unknown or other
  misc_feature (378)..(378): n is a, c, g, or t
  modified_base (443)..(443): a, c, t, g, unknown or other
  misc_feature (443)..(443): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccagagtccacgggaagggcctggagtggattggtttaattagaagtaaaactctacgtgggacagttgaatacgctnatctgtagaaaggcagatttaccatctcacgagatgatgaccaaaatctagctatcttacaaatnaaacagcctaggagacggacgacagcgaccagatatactctgttgtcgactacgtttcggtcgtcgggaacccctaaaagttcgaaccgtaaacggtcgggggtacccggaatttcccgg

SEQ ID NO: 334068 - DNA, 546 bp, Homo sapiens
  misc_feature: GZ8MTXP02JR87W.39.5.A05.1.454.CMB.2.raw
  modified_base (270)..(270): a, c, t, g, unknown or other
  misc_feature (270)..(270): n is a, c, g, or t
  modified_base (356)..(356): a, c, t, g, unknown or other
  misc_feature (356)..(356): n is a, c, g, or t
  modified_base (377)..(377): a, c, t, g, unknown or other
  misc_feature (377)..(377): n is a, c, g, or t
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcncctttggtgtatttcgctttgaggttggggtgcgccagagtccacgggaagggcctggagtggattggtttaatagaagtaaactntacgtggacagtgaatcgctnatctgtgaaagcagattaccatcncacgagatgatgacaaaatctagcctatcttanaaatgaaacngcctaggaggacgacgacagcgaccagatatctctgtcgttcgactacgttcggccgtacggaaccctaaagttcgacacggtcggggacccggaatcccgg

SEQ ID NO: 334069 - DNA, 600 bp, Homo sapiens
  misc_feature: GZ8MTXP02GIFJY.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtcccctgacactgtcgtagtaaagcgtcgtgggttcgccgtttggtgtatttcgtctttggagtttggggtgccgccaggacgtccgacgggaacgggcctgggagtggtatttaggtttaaatagaaagttaaaactcgtacggtagggactaggttagaatacgcctcatcgtgtagaaaggcagtatttaacccatcctacaacgagatagatagaaccaaaaatctagacctatacttaacaaatgaaacagacctaggaacggaacgacgacagacgccaagactagtctctgtcgtcgactcgtttcggcgtacggaacctaaagttcgaacgtaacgtcggggacccggtattcccg

SEQ ID NO: 334070 - DNA, 547 bp, Homo sapiens
  misc_feature: GZ8MTXP02G6OG7.39.5.A05.1.454.CMB.2.raw
  modified_base (303)..(303): a, c, t, g, unknown or other
  misc_feature (303)..(303): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgcttgagttgggtgcgcagngtccacggaaggcctggagtggtattggtttaattagaagtaaaactcgtaacgtggacagtgaatacgctcatctgtgaaagcagattaccatctcacgagatgatgacaaaatctagacctatctacaaatacgaacagacctaggaggacgacgaacagcgaccagatatctctagtcgttcgactcgttacggcgtggaaccctaattcgactacgtacggggaccggtaacgttcccgg

SEQ ID NO: 334071 - DNA, 566 bp, Homo sapiens
  misc_feature: GZ8MTXP02GM1Z8.39.5.A05.1.454.CMB.2.raw
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccagagtccacgggaaggcctggagtggattggtttaatagaagtaaactctacgtggacagttgaatacgcctcatctgtagaaaggcagatttaccntcctnacganatgatgaaccaaaaatactagaccctataccttacaaatgaaacagcctaggaacggacgacgacagcgccagatactctacgtgtcgttcgactacgtttcggcgtcggaaccctaaagttcgaactaacggtcgggggaccccggtaattcccgg

SEQ ID NO: 334072 - DNA, 561 bp, Homo sapiens
  misc_feature: GZ8MTXP02IK6OW.39.5.A05.1.454.CMB.2.raw
  modified_base (309)..(309): a, c, t, g, unknown or other
  misc_feature (309)..(309): n is a, c, g, or t
  modified_base (383)..(383): a, c, t, g, unknown or other
  misc_feature (383)..(383): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgccttttggtgatttcgcttttggagttgggtgcgccagngtccagggaaggcctgggagtggattggtttaattaggaagtaaaactctacgtgggacagttgaatacgcctnatctgtagaaaggcagtactttacattctcacgagatgatgaactaaaatactgacctatcttacaaatgaaacagcctagaggacggacgacagcgccagatatctctgtgttcaactcgtttacggcgtacggtaaccctaaattcgacaacggtcgggggacccggaacttccgg

SEQ ID NO: 334073 - DNA, 663 bp, Homo sapiens
  misc_feature: GZ8MTXP02IWK3P.39.5.A05.1.454.CMB.2.raw
  modified_base (301)..(301): a, c, t, g, unknown or other
  misc_feature (301)..(301): n is a, c, g, or t
  modified_base (380)..(380): a, c, t, g, unknown or other
  misc_feature (380)..(380): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatctggaaggtgtccaatgtgaagtgcaactggtggagtcgtgggggacacttggcccagccaggccagtccctgacactgtcgtgtaaagcgtctgggttcgctttggtgatttcgcttgagttggtgcgcagngtccacgggaggcctggagtggtattaggtttaattaggaaagtaaaactcgtaggtaggactagttagaatacgcctnattctgtagaaaggcagtactttaccattctacacgagatgatagaaactaaaatactacgtaccttatacttaaacaaattcggaaaactagtacccgtagggaaaccgggaacggaccggaacgacggaccgaccgaagtattaacgttcctacgttcgttacggttaccgtaaccgttacgtttacgggaccggttaccggggtaaaccctaaaaggttttaccggaaaaccgtaaccggggttcccgggggtaaccccgggggtaaactttccccgggg

SEQ ID NO: 334074 - DNA, 559 bp, Homo sapiens
  misc_feature: GZ8MTXP02I9C14.39.5.A05.1.454.CMB.2.raw
  modified_base (409)..(409): a, c, t, g, unknown or other
  misc_feature (409)..(409): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgccttggtgatttcgcttgagttggtgcgccagagtccacggaaggcctggagtggattggtttaattagaagtaaactctacgtgggacagttgaatacgcctcatctgtagaaaggcaagatttaccatcctcacganatgatagaccaaaatactagacctatacttacaaatgaaacagacctagagacggacgaacagcgacctagatactctctgtcgttacgactacgtttcggcgttcggaaccctaaattcgaacaacgtcggggaccccggtaatcccgg

SEQ ID NO: 334075 - DNA, 612 bp, Homo sapiens
  misc_feature: GZ8MTXP02JAL4A.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaactgggttttctttgtggctatcttggaaggtgtccaatgtgaagtgcaactggtggagtcgtgggggacacttggcccagccaggccagtccctgacactgtcgtgtaaagcgtctgggttcgcctttggtgatttcgctttgaggttgggtgcgccagacgtccgagggaaggcctggagtggagtttggtttaattagaagttaaaactctacgtgggacagttgaatacgcctcattctgtagaaaggcagtactttaaccatcctacgacgagtatagattagaacccaaaatactagaccttatcctttaacaaaattagaaacctagacccttagggaacgggacggaaccgacacggcgaccagatatactctagttcgtacgacttacgtttacggccgtacggcccctaaaagttcggaacccgtaacgggtccgggggacccggaactttcccggg

SEQ ID NO: 334076 - DNA, 559 bp, Homo sapiens
  misc_feature: GZ8MTXP02FRNYU.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccagagtccacgggaagggcctggagtggattggtttaatagaagtaaaactctacgtgggacagttgaatacgctcatctgtgaaaggcagatttaccatctcacgtagatgatgaccaaaatactagcctatcttacaaatagaacagcctagaggacggacgacgagcgccaagataatctctgttcgttcgactacgtttacggcgttaggaacccctaaattcgaactacggtcggggacccggtaattcccgg

SEQ ID NO: 334077 - DNA, 562 bp, Homo sapiens
  misc_feature: GZ8MTXP02IRYN3.39.5.A05.1.454.CMB.2.raw
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
  modified_base (443)..(443): a, c, t, g, unknown or other
  misc_feature (443)..(443): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccagagtccacgggaaggcctggagtggattggtttaattagaagtaaactntacgtgggacagttgatacgcctcatctgtgaaaggnagatttaccatctcacgagatgatgaccaaaaatactacgtacctatactttanaaatagaacagcctagaggacgacgacagcgccagatatactctagtcgttcgactacgtttcggcgttcggaaccctaaacgtttgaaccaacgtcgggggacccggaacgttcccgg

SEQ ID NO: 334078 - DNA, 560 bp, Homo sapiens
  misc_feature: GZ8MTXP02H4OMY.39.5.A05.1.454.CMB.2.raw
  modified_base (379)..(379): a, c, t, g, unknown or other
  misc_feature (379)..(379): n is a, c, g, or t
  modified_base (444)..(444): a, c, t, g, unknown or other
  misc_feature (444)..(444): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggccagccaggccagtcccctgacactgtcgtgtaaagcgtctgggttcgcctttggtgatttcgctttgagttgggtgcgccagagtccacggaaggcctggagtggattggtttaaatagaagtaaaactctacgtgggacagttagaatacgcctanatctgtagaaagcagtacttacatctacagagatagatagaaacaaaatctacgacctatactanaaatagaacagactagaggaacgacgacgagcacagtatactctctgtactacgactacgttcggcgtacgaaccctaaagttacgacgtaacggtacggggacccggtaactccg

SEQ ID NO: 334079 - DNA, 621 bp, Homo sapiens
  misc_feature: GZ8MTXP02GLMRV.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacgttggcccagccaggccacgtccctgacactgtcgtgtaagcgtctgggttcgtccgtttggtgtatttcgtcgtttggaggttgggtgcgccagagtccgacgggaaggccgtggagtggtatttaggtttaaataaggtaaagttaaaactcgtaacggtagggactaggttagaataccgcctcgattcgtgtagaaaggtcagtactttacatctacacgagatgaatacgaaacctaaaagtctacgtacctattctaaacaaatagaacgacgccgtagggaacggaaccggacgacgacgaccgaccaagacttactcgtcgttgttacgttcgacttacgttcggcgttacggaaccctaaagtcgacgaaccggtcggggacccgtacttccgg

SEQ ID NO: 334080 - DNA, 609 bp, Homo sapiens
  misc_feature: GZ8MTXP02IT0XN.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcggctaactgggttttcttgtggctatcttggaaggtgtccaatgtgaagtgcaactggtggagtcgtgggggacacgttggcccagccaggccagtccctgacactgtcgtgtaaagcgtcgtggttcgcctttggtgtatttcgctttgagttgggtgcgccagagtccgacgggaagggccgtggaggtggtagtttagggttttaaattaggaaaagttaaaactcgttacggtggggaactaggttagaatacgcctcacttctgtagaaaggcagtatttacatctacacgagatgatagaaccaaaattactagtacctattactttaacaaaattcgaaaactacgacctagggaacgggacggaaccgacgacggccgaccaagactatcctgttgtcgttacgactacgtttcggcgtcggaacctaagtcgaacgacgtccgggggacccggtaatccgg

SEQ ID NO: 334081 - DNA, 555 bp, Homo sapiens
  misc_feature: GZ8MTXP02I20QW.39.5.A05.1.454.CMB.2.raw
  modified_base (306)..(306): a, c, t, g, unknown or other
  misc_feature (306)..(306): n is a, c, g, or t
  modified_base (409)..(409): a, c, t, g, unknown or other
  misc_feature (409)..(409): n is a, c, g, or t
  modified_base (447)..(447): a, c, t, g, unknown or other
  misc_feature (447)..(447): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgcctttggtgatttcgctttgagttgggtgcgccagngtccacgggaaggcctggagtggattggtttaattagaagtaaactctacgtggacagttgatacgctcatctgtagaaaggcagtatttaccatctcacganatgatgaacaaaagtctgactatcttacaaatgaaacngcctagacggacgacgacagcgcagatatctatgtcgttacgactacgtttcggcgttacggaaccctaaagttcgaacgtaacggtcgggggacccgtaattcccgg

SEQ ID NO: 334082 - DNA, 573 bp, Homo sapiens
  misc_feature: GZ8MTXP02IQ6GW.39.5.A05.1.454.CMB.2.raw
  modified_base (401)..(401): a, c, t, g, unknown or other
  misc_feature (401)..(401): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccagagtccacgggaagggcctggagtggattggtttaaattagaagtaaaactctacgtgggacagttgaatacgctcatctgtgaaagcagtatttacntctcagagatagatagaccaaaaatactagtacctatcttacaaaatgaacagcctgaacggacgacgacacgcgccaagatatctctgtcggttcgactacgtttcggcgttacgggaaccctaaaagttcgaccgtaaacggtcgggggaccccgggtaaatttccccgg

SEQ ID NO: 334083 - DNA, 592 bp, Homo sapiens
  misc_feature: GZ8MTXP02HYBA7.39.5.A05.1.454.CMB.2.raw
  modified_base (307)..(307): a, c, t, g, unknown or other
  misc_feature (307)..(307): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtcgtgggtcgccgttggtgtatttcgctttgagttgggtgcgccagngtcccgacgggaggcctggagtggtagtttggtttaaatagaaagtaaaactcgtacgtggactagtagaatacgctcatctgtagaaagcagtacttacatctacacgagatgatcgaactaaaaatctagacccttatacttacaaatacgaacacgtacctagggaacggacgggaacgaaccgacgaccgaccgagtaacgtaactctacgttgtacgttacgactaccgttcggacgtcggaaccctaagttcgacacggtcgggacccggtaatcccgg

SEQ ID NO: 334084 - DNA, 593 bp, Homo sapiens
  misc_feature: GZ8MTXP02HJ75S.39.5.A05.1.454.CMB.2.raw
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (374)..(374): a, c, t, g, unknown or other
  misc_feature (374)..(374): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctggttcgcctttggtgatttcgctttgagttgggtgcgccagngtccaggaggccnggagtggattggtttaattagaagtaaaactctacgtgggacagttagatacgctnatctgtagaaaggcagtactttaccattctacacgagatgatagaaacctaaaaatactacgtacccttaatacctttacaaaagttcgaaactagacccgtaggacggacggacgacgagtcgaccagactactctacgtgtcgttacgactacgttcggcgttacggaaccctaaaagttacgacgtaaacggtccggggacccggaacgttcccgg

SEQ ID NO: 334085 - DNA, 566 bp, Homo sapiens
  misc_feature: GZ8MTXP02F904A.39.5.A05.1.454.CMB.2.raw
  modified_base (470)..(470): a, c, t, g, unknown or other
  misc_feature (470)..(470): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttcttgtggctatcttggaaggtgtccaatgtgaagtgcaactggtggagtctgggggacacttggcccagccaggccagtccctgacactgtcgtgtaaagcgtctgggttcgcctttggtgatttcgctttggagttgggtgcgccagagtccacgggaggcctggagtggattggtttaatagaagtaaaactctagtggacagttgaatacgcctcatctgtagaaaggcagatttacatctcacgagatgatgaccaaaaatactagcctatcttacaaatgaactagcctaggaggacggacgacaggcnccgagatatctctgtcgttacgactacgtttcggccgttacggaacccctaaaagtttcggaactaaccggtcgggggaccccggaacgttcccgg

SEQ ID NO: 334086 - DNA, 565 bp, Homo sapiens
  misc_feature: GZ8MTXP02JXLZF.39.5.A05.1.454.CMB.2.raw
  modified_base (451)..(451): a, c, t, g, unknown or other
  misc_feature (451)..(451): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgcttgagttgggtgcgccagagtccgaggaaggcctggagtggattggttaatagaagtaaactcgtacgtgggactagtagaactacgcctcatctgtagaaaggcagtactttacattctacacgagatgatgaacaaaatctagacctatactacaaatacgaanacgctaggaggacgacgacgacgcgacagtatactactcgtgtcgttcgactacgttcggtccgttacggaaccgtaattcgactaacggtcggggtacccggtaacgttccgg

SEQ ID NO: 334087 - DNA, 569 bp, Homo sapiens
  misc_feature: GZ8MTXP02INKI9.39.5.A05.1.454.CMB.2.raw
  modified_base (377)..(377): a, c, t, g, unknown or other
  misc_feature (377)..(377): n is a, c, g, or t
  modified_base (442)..(442): a, c, t, g, unknown or other
  misc_feature (442)..(442): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctggttcgcctttggtgtatttcgctttgagttgggtgcgccagagtccacgggaaggcctggagtggattggtttaattagaagtaaactctagtgggactagttagaatacgctnatctgtgaaaggcagtactttacattctacacgagatgatgaaccaaaatctagacctatcttanaaatagaaacagcctaggaacggacggacgacagcaccgagatactctctgtcgttacgactcgttaggccgttggaacccctaaagttcgaccgtaacggtccgggggtacccggtaacttcccgg

SEQ ID NO: 334088 - DNA, 628 bp, Homo sapiens
  misc_feature: GZ8MTXP02GMRS7.39.5.A05.1.454.CMB.2.raw
  modified_base (272)..(272): a, c, t, g, unknown or other
  misc_feature (272)..(272): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttgggcccagccaggccagtccctgacactgtcgtagtaagcgtcgtgggttcncctttggtgtatttcgctttgaggttgggtcgcgccagagtcccgacgggaagggcctgggagtggatttggtttaataggaaagttaaaactcgtacgtgggacagttgaatacgctnatcngtgaaagcagtatttaccatctacacgagatgatagaaccaaaagttctacgtacctattaccttaacaaaatacgtaaacacgaccgtagggaacgggaaccggaaccgaacgaacggccgaccaagtaactattcctcgttgttcgttaccgacgtacgtttcggaccgtacggaaccctaaacgttacgaaccgtaaccggtacgggggtacccccggtaagtttcccgg

SEQ ID NO: 334089 - DNA, 576 bp, Homo sapiens
  misc_feature: GZ8MTXP02F4NZI.39.5.A05.1.454.CMB.2.raw
  modified_base (384)..(384): a, c, t, g, unknown or other
  misc_feature (384)..(384): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccagagtccacgggaagggcctggagtggatttggtttaaattagaaagttaaaactcgtacgtgggacagttgaatacgcctnattctgtagaaaggcaagtatttaaccattctcacgagatgatagacaaaatctagcctatcttaacaaatcgaacagcctaggacggacggacgacagcgccagatactactctagtcgttcactcgtttaggcgttacggaaccctaaagttcgacgtaaaccggtcgggggacccggtaactttcccgg

SEQ ID NO: 334090 - DNA, 609 bp, Homo sapiens
  misc_feature: GZ8MTXP02HZFQV.39.5.A05.1.454.CMB.2.raw
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtgactatcttggaaggtgtccaatgtgaagtgcaactggtggagtcgtgggggacacttggcccagccaggccagtccctgacactgtcgtgtaaagcgtctgggttcgcctttggtgtatttcgctttgaggttgggtgcgccagagtcccgacgggagggcctgggagtggtatttggtttaaattagaaagtaaaactcgtaacgtggggactagttgaatacgcctnatctgtgaaaggcagtatttaccattcncacgagatgatgaaccaaaaatactagaccttatcttacaaatagaaactagccgtagaggacggaacgacgacgcgacccaagacttaactcgtcgtggttcgttacggaccttacgtttcggaccgttacgggaacccctaaaagttacgaccgtaacggtacgggggtaccccggaacgtttcccg

SEQ ID NO: 334091 - DNA, 586 bp, Homo sapiens
  misc_feature: GZ8MTXP02FVUGQ.39.5.A05.1.454.CMB.2.raw
  modified_base (377)..(377): a, c, t, g, unknown or other
  misc_feature (377)..(377): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccgagagtccacgggaaggcctggagtggattggtttaatagaagtaaaactctagtgggacagttgaatacgcctnatctgtagaaaggcagtatttacatctacacgagatgatgaaccaaaaattactagtaccttaatcttaacaaatagaacagcctaggaacggacggacgacacgcgaccaagactatctctagtcgttacgactacgtttcgggcgttacgggaacccctaaaagttcggaaacctacggtacgggggacccgggtaactttcccggg

SEQ ID NO: 334092 - DNA, 573 bp, Homo sapiens
  misc_feature: GZ8MTXP02H6KD2.39.5.A05.1.454.CMB.2.raw
  modified_base (277)..(277): a, c, t, g, unknown or other
  misc_feature (277)..(277): n is a, c, g, or t
  modified_base (383)..(383): a, c, t, g, unknown or other
  misc_feature (383)..(383): n is a, c, g, or t
  modified_base (454)..(454): a, c, t, g, unknown or other
  misc_feature (454)..(454): n is a, c, g, or t
  modified_base (493)..(493): a, c, t, g, unknown or other
  misc_feature (493)..(493): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactgggtggagtcgtgggggacacttggcccagccaggccagtccctgacactgtcgtgtaagcgtctgggtcgcctttggngatttcgctttgagttgggtgcgccagagtccgacgggaggcctggagtggatttggtttaaattaggaagtaaaactcgtaacgtgggacagttgaaatacgctnatctgtagaaagcagtatttaccatcctacacgagatgatgaccaaaaatctagccttatacttacaaatnaacagctaggagacggacacgacgcgtccaagatactcncttgtcgttacgactacgtttcggcgtacggaaccctaaaagttcgaaccgaacgtcgggggacccggtaaacttcccgg

SEQ ID NO: 334093 - DNA, 594 bp, Homo sapiens
  misc_feature: GZ8MTXP02HK7S7.39.5.A05.1.454.CMB.2.raw
  modified_base (380)..(380): a, c, t, g, unknown or other
  misc_feature (380)..(380): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtcgtgggttcgccgtttggtgtatttcgctttggagttgggtgcgccagagtccgacgggaaggcctggagtggtattggtttaatagaagtaaactcgtagtggacagttgatacgctnatctgtagaaagcagtatttacatctcacgagatgatagaacctaaaaatctgtacctattcttacaaactgaactagcctaggacggacgacgacgagcaccagactacgttctacgtgttacgttaccgacgttacgtttcgggacgttacggtaacccctaaagtttacggaaccgtaaaccggtcgggggaccccggtaacgtttcccgg

SEQ ID NO: 334094 - DNA, 588 bp, Homo sapiens
  misc_feature: GZ8MTXP02JYGYZ.39.5.A05.1.454.CMB.2.raw
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactgggtggagtcgtgggggacacttggcccagccaggccagtccctgacactgtcgtgtaaagcgtctgggttcgcctttggtgtatttcgtctttgtagttgggtgcgccagagtccgacgggaagggcctggagtggagttggtttaaattagaagtaaaactcgtagtggacagtgaatacgctnatctgtgaaaggcagtacttacatctacacganatgatgaactaaaatctagacctatacttanaaatanaacagacctaggaacggacgacgaacgagcgaccaagactatctcgtgttcgttacgtacgtacgttcggcggttacgaacccgttaaagttacgaacccgtaacggtcgggggtacccggtaacgtttcccgg

SEQ ID NO: 334095 - DNA, 546 bp, Homo sapiens
  misc_feature: GZ8MTXP02F21OO.39.5.A05.1.454.CMB.2.raw
  modified_base (483)..(483): a, c, t, g, unknown or other
  misc_feature (483)..(483): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgtatttcgctttgagttgggtgcgccagagtccacgggaagggcctggagtggattggtttaaatagaagtaaaactctacgtgggacagttagaatacgcctcatctgtgaaaggcagatttaccatctcacgagatgatgaccaaaaatactgcctatcttacaaatgaacagcctagagacggacgacagcgccagatatctntgtcgttcgactactttggcgttggaacccaaattcgacaacgtcgggggacccggaattccg

SEQ ID NO: 334096 - DNA, 603 bp, Homo sapiens
  misc_feature: GZ8MTXP02GH9UG.39.5.A05.1.454.CMB.2.raw
  modified_base (470)..(470): a, c, t, g, unknown or other
  misc_feature (470)..(470): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgcctttggtgtatttcgtctttggaggttgggtgcgccagagtccacgggaaggcctggagtggtattggtttaaatagaaagtaaaactcgtacggtggacagttagaatacgcctcatctgtagaaaggcaagtatttaccattcctacacgagatagatacgaacctaaaaatctagtacctattacttaacaaatanaaactacgaccgtagaacgggaacgaacgaacgacgccgaccaagactactctacgttgtcgttacgactacgtttcggcgttacggaaccctaaaagttcgaaaccgtacgtacggggaccggaacttccgg

SEQ ID NO: 334097 - DNA, 684 bp, Homo sapiens
  misc_feature: GZ8MTXP02JC4YS.39.5.A05.1.454.CMB.2.raw
  modified_base (268)..(268): a, c, t, g, unknown or other
  misc_feature (268)..(268): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatgaatcggctaaactggtttcttgtggctatcttggaaggtgtccaatgtgaagtgcaactgatggagtcgtgggggacacgttggcccagccaggccacgtccctgacactgtcgtagtaaagcgtcgtgggttcnccgtttggtgtattcgctttgtgttgggtgcgccgagacgtccgacgggacggcctggagtggtatttagggtttaaattaagaaagttaaaacctcgtaacggtgggacctaggttagaaataccgctctaatccgttagtaaggaaacggactagtaactttacccatacctacgaacgtaagactagtaactacgaaccctaaaaatcctactacccttaattaccttaaacaaaagttacgaaactacggaccgttacggaaacggaaccggaaccgacgaacgccgaaccagtaacttactcgttacgttcggttacgttaccgtaaccgttacgttcgggacccgttaacgaacccgttaaacggttacgaacccggtaaccgggtaccgggggaaccccgtttaaccgg

SEQ ID NO: 334098 - DNA, 573 bp, Homo sapiens
  misc_feature: GZ8MTXP02GACBG.39.5.A05.1.454.CMB.2.raw
  modified_base (307)..(307): a, c, t, g, unknown or other
  misc_feature (307)..(307): n is a, c, g, or t
  modified_base (410)..(410): a, c, t, g, unknown or other
  misc_feature (410)..(410): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtcgtgggttcgcctttggtgtatttcgctttgagttgggtgcgccagngtccaggaaggcctggagtgattggttaatagaagtaaaactctacgtggacagttagaatacgctcatctgtagaaaggcaagtactttacatctacacganatgatgaacaaaaatactagacctatcttacaaaatagaaacagacctagaaggaacggacgaacagcgaccagactatcctatcgtgtcgactacgtttcggcgttcgaacccgtaaagttcgaaaccgtaacggtcgggggaccccgtaagttcccccggg

SEQ ID NO: 334099 - DNA, 682 bp, Homo sapiens
  misc_feature: GZ8MTXP02JL8CL.39.5.A05.1.454.CMB.2.raw
tcagtcgcactagtcacgaccggtgctcgatttagatagatagacaggggaggtctgggagaggagccccagccgtgagattcccaggagtatccacctggagatcagcactaaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctggggttcgcctttggtgtatttcgctttgagtttgggtgcgccagagtccgacggaagggcctggagtggagtttggttaattagtaaagtaaactcgtagtggactagttagatacgcctcatctgtgaaagcagtacttacatctcacgagacgtgatcgaaaccctaaaaatacctacgtacccttaattaccttaactaaaacgttacgaaaaccgtacggtacccgttagggaaacggggaaacccgggaaaccggacgaaacggcccggacccgaaggtacttaactccttaacgttcggtttacgtttaccgaaccgttacggtttcgggtaccggtccggtaacctaaacgttacggtaaccgtaaaccggggtccgggggtaacccgggtaacgttcccggtttacccggg

SEQ ID NO: 334100 - DNA, 640 bp, Homo sapiens
  misc_feature: GZ8MTXP02J3NEF.39.5.A05.1.454.CMB.2.raw
  modified_base (272)..(272): a, c, t, g, unknown or other
  misc_feature (272)..(272): n is a, c, g, or t
tcagtcgcactagtcacgaccggtgctcgatttagatagatagacaggggaggtctgggagaggagcccagccgtgagattcccaggagtatccacctggagatcagcactgaacacagacccaccaaccatggaattcgggctaaactgggttttcttgtgctatcttggaagtgtccaatgtgaagtgcaactgggtggagtcgtgggggacacttggcccagcccaggccagtccctgaccacttgtcgtgtaaagcgtcgttgggtcnctttggtgatttcgctttgagttgggtgcgccagagtcccgacgggaagggcctgggagtggtaatttggttttaaaatttaaggaaagttaaaacctcgttacggtggggactagttgaaatccgactctatctgtagaagcatattccatctcacgagatgataacgaacctaaaaacttctacgtcctaacttacttacaaaattaacgaactacgtacccgaggacggaaccgggaccgaacgagaccggcccaaagtataactttctcgttgttacgtttaccgacgttaccgttttggccgtcggtaacccctaaattacgtaccgaaacggtccgggggttacccggaaacgtttccccgg

SEQ ID NO: 334101 - DNA, 662 bp, Homo sapiens
  misc_feature: GZ8MTXP02GGK0A.39.5.A05.1.454.CMB.2.raw
tcagtcgcactagtcacgaccggtgctcgatttagatagatagacagggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactgggtggagtcgtgggggacacgttggcccagccgaggccagtccctgacactgtcgtgtaaagcgtcgtgggttcgtcctttggtgtatttcgtctttggtagttggggtgcgtccagacgtcccgacgggaagggcccgtagggaggtgggtagtttaggttttaaaattaggtaaaagttaaaactcgtaacggtagggactagttagaaatacgcctcatctgtgaaagcagtattacatctacacgagatgatagaacccaaaaatctagtacctaatacttaacaaatagaaactacgccgtagaacgggaaccgacgacgacgaccgaccgtaagtacaacttccgttaactttgggttacgttaccgtaacgttacgtttacgggccgtacggaaccccgttaaagtttacgaaaacgtaaccgggtaccgggggaacccggtaacgtttcccggg

SEQ ID NO: 334102 - DNA, 567 bp, Homo sapiens
  misc_feature: GZ8MTXP02F85QW.39.5.A05.1.454.CMB.2.raw
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
  modified_base (386)..(386): a, c, t, g, unknown or other
  misc_feature (386)..(386): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtnatttcgctttgagttgggtgcgccagngtccgaggaaggcctggagtggattaggtttaatagaagttaaaactcgtacgtgggactagttagaatacgcctcattcngtagaaggcagtatttacatctacacgagatgatacgacaaaatctagacctataccttacaaatcgtaaacagacctaggaacggacgacgacgagccaccgagactatctctagtcgtacgactacgttcgcgtcggaaccctaagttcgaactacgtcggggacccggtaattcccgg

SEQ ID NO: 334103 - DNA, 549 bp, Homo sapiens
  misc_feature: GZ8MTXP02J1QXR.39.5.A05.1.454.CMB.2.raw
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgtcctttggtgatttcgctttgagttggtgcgccagagtccacggaggcctggagtggattggtttaatagaagtaaactctacgtggacagtagaatacgcctnatctgtgaaaggcagtatttacatctacagagatagatgacaaaatctagacctatctacaaatgaacngctagagacgacgacagcacagatctactctgtcgttacgactacgttcggcgttacggaaccctaaaagttcgaacgtaccggtcgggggtacccggaattcccgg

SEQ ID NO: 334104 - DNA, 547 bp, Homo sapiens
  misc_feature: GZ8MTXP02HR1DR.39.5.A05.1.454.CMB.2.raw
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagttgggtgcgccagagtccacggaggcctggagtggattggtttaattagaagtaaactntacgtggacagtgaatcgctnatctgtagaaagcagtattacatcctnacgagatgatgaccaaaatctagcctatcttacaaatcgaaacagcctggacgacgacgacagcgccagatatctactgtcgttcgactacgtttggccgtgggaaccctaaagttcgaacaacggtcggggacccgggtaattcccgg

SEQ ID NO: 334105 - DNA, 657 bp, Homo sapiens
  misc_feature: GZ8MTXP02FI9NL.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaatcgggctaaactgggttttctttgtggctatcttggaaggtgtccaatgtgaagtgcaactgggtggagtcgtgggggacacgttcggcccagcccaggccacgtcccctgacactgtcgtgtaaagcgtctgggttcgtccttggtgtattcgctttgagttggggtgcgcagagtccgacgggaggccgtggagtggtagtttggtttaaattagaaagttaaaactcgtacggtaggggactagttagaactacgcctcatcgtgtagaaacggcagtacttaccatctacaacgagtagtgaactacgaaaacctaaaaattctacgtaccttacttacttaaaccgtaaagtacgaaacacgtacccgtagggaacgggtaacccggacgacgacggaccgaccgaagtactactacgtcgttaggtcgttaccgacgttcgtttacgggcgttaccgaaacccgtaaagttaccggaacgtaaccgggtcgggggtaaccccgtacgtttcccgg

SEQ ID NO: 334106 - DNA, 562 bp, Homo sapiens
  misc_feature: GZ8MTXP02HN7DQ.39.5.A05.1.454.CMB.2.raw
  modified_base (286)..(286): a, c, t, g, unknown or other
  misc_feature (286)..(286): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccacgtccctgacactgtcgtgtaaagcgtcgtggttcgctttggtgatttcgnttgagttgggtgcgccagacgtccacgggaggctggagtggtattggtttaaatagaaagtaaactcgtagtgggacagttnaatcgcctnatctgtgaaagcagatttacatctnacgagatagatagaccaaaaatctacgacctatacttacaaatagaacagaccgtaggacggacgacgacgacgcgaccagatctctctgtcgttcgactacgttaggccgtacggaacctaaagttcgaaccgtacggtcgggggacccgtacgttccg

SEQ ID NO: 334107 - DNA, 573 bp, Homo sapiens
  misc_feature: GZ8MTXP02FHTTG.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtgactatcttggaaggtgtccaatgtgaagtgcaactggtggagtctgggggacacttggcccagccaggccagtccctgacactgtcgtgtaaagcgtctgggttcgcctttggtgtatttcgctttggagttggggtgcgccagagtccacgggaagggcctgggagtggtatttggtttaaattagaaagttaaaactctacgtggggacagttgaatacgcctcatctgtagaaaaggcagatttaccatctacacgagatgatagaccaaaaatactagcctatcttacaaatagaacagcctagaggaccggacgacagcgaccagatatactctgtcttcgactacgtttcggcgttcggaaccctaaagttcgaacgacggtacgggggacccggtattcccgg

SEQ ID NO: 334108 - DNA, 614 bp, Homo sapiens
  misc_feature: GZ8MTXP02IZE2Z.39.5.A05.1.454.CMB.2.raw
  modified_base (279)..(279): a, c, t, g, unknown or other
  misc_feature (279)..(279): n is a, c, g, or t
  modified_base (377)..(377): a, c, t, g, unknown or other
  misc_feature (377)..(377): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgcctttggtntatttcgctttgagttgggtgcgccagagtccagggaggcctggagtggattggtttaaattagaagtaaactctacgtggacagttgaatacgcctnatctgtagaaggcagtacttacgatctacacgagatagatgaaccaaaatctacgacctatcttactaaatcgaaacacgcccgtagggaacgggaaccgggaacgaacacgggaccgacccgaagtaactacgttacctcgttaggttcgttacggaaccttacgtttcggtaccggttacggaaccctaaaagttcgaaacgtaacggtccgggggacccggtaacgtttcccgg

SEQ ID NO: 334109 - DNA, 639 bp, Homo sapiens
  misc_feature: GZ8MTXP02JH64D.39.5.A05.1.454.CMB.2.raw
  modified_base (426)..(426): a, c, t, g, unknown or other
  misc_feature (426)..(426): n is a, c, g, or t
tcagtcgcactagtcacgaccggtgctcgatttagatagatagacaggggaggtctgggagaggagccccagccatgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtagtaaagcgtctgggttcgcctttggtgatttcgctttgagttgggtgcgccgagacgtccgacggaacggggcctggaggtggtagtttgggttttaaagtagtaaagtaaaactctaacggtggacctagttagaatacgcctacatctgtagaaagcagtatttaccattcncacgagactgatacgaacctaaaaatcgtagaccttataccttacaaatcgaaaccgagacccgtagaacgggaaccgacggaacgaggccgaccgaagattacgtacttcgacggtttcggttaccgtactaacggttttcggaccggttaacggacccgtaaaacgtttacggaaccgtaaccgggttacgggggaccccggttaaaccgg

SEQ ID NO: 334110 - DNA, 620 bp, Homo sapiens
  misc_feature: GZ8MTXP02H3PSY.39.5.A05.1.454.CMB.2.raw
  modified_base (491)..(491): a, c, t, g, unknown or other
  misc_feature (491)..(491): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacgttggcccagccaggccagtcccctgacactgtcgtagtaagcgtctgggttcgctttggtgtatttcgctttggtaggttgggtgcgccaggacgtccgacgggaaggcctgggagtggtatttggtttaaataggaaagttaaaactcgtaacggtgggtacaggtttagaactacgccttacagttcctggttagaaaacggtcaagtaactttaccattcctacaacgagatagatagaaacctaaaaatactacgaccttatacttanaaatacgaaacacgaccgtaggacgggaacgacgacgacgcgaccagatactctcgttgtcgtcgaacttcgttcggtcgtacgaacccgaaagttcgaaccgtacggtccggggacccggtaagtccg

SEQ ID NO: 334111 - DNA, 618 bp, Homo sapiens
  misc_feature: GZ8MTXP02HSCXW.39.5.A05.1.454.CMB.2.raw
  modified_base (330)..(330): a, c, t, g, unknown or other
  misc_feature (330)..(330): n is a, c, g, or t
  modified_base (406)..(406): a, c, t, g, unknown or other
  misc_feature (406)..(406): n is a, c, g, or t
  modified_base (487)..(487): a, c, t, g, unknown or other
  misc_feature (487)..(487): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactgggtggagtcgtgggggacacgttggcccagccaggccagtcccctgacactgtcgtgtaaagcgtctgggttcgcctttggtgtatttcgctttgaggttgggtgccgcagagtcccgacgggagggtccnggaggtggagtttaggtttaaattaggaaagttaaaactcgtacggtgggactacggtttagaaactacgccttanattcgtgtagaaagcagtactttacccattcctcaacgatagtagattacgaaactaaaaatctacgtacctatacttaanaaatagaaactagacccgtaggacggacggacgacagaccgacagactctactcgttagtctcgtacgtacgttcggcgttcgaacccgtaagttacgacgtaaacggtccgggggacccggtattcccgg

SEQ ID NO: 334112 - DNA, 576 bp, Homo sapiens
  misc_feature: GZ8MTXP02IWO3D.39.5.A05.1.454.CMB.2.raw
  modified_base (450)..(450): a, c, t, g, unknown or other
  misc_feature (450)..(450): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctggttcgcctttggtgatttcgctttgagttgggtgcgccagagtccacgggaagggcctggagtggattggtttaattagaagtaaaactctacgtgggactagttgatacgctcatctgtgaaaggcagtattacatctcagagatgatgacaaaattacacgtcctatcttacaaaattgaaacngcctaggacgacggacgacagcgccaagataactctctgtcgttacgactacgtttcggcgttacggaaccctaaaagtttcgaaaccgtaacggtaccgggggtacccggtaaacgtttcccggg

SEQ ID NO: 334113 - DNA, 548 bp, Homo sapiens
  misc_feature: GZ8MTXP02IVJSA.39.5.A05.1.454.CMB.2.raw
  modified_base (353)..(353): a, c, t, g, unknown or other
  misc_feature (353)..(353): n is a, c, g, or t
  modified_base (453)..(453): a, c, t, g, unknown or other
  misc_feature (453)..(453): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttgagtttgggtgcgccagagtccacggaagggcctggagtggattggtttaattagaagtaaactntacgtggacagttgaatacgccttcattctgtagaaaggcagtatttaccgattctcacgagatgatgacaaaagtactgacctatcttacaaatgaacngcctgaggacggacgacagcgacagatatactctgtcgttcgactacgttgcgttgaaccctaaatcgacaacgtcggggaccggtaattcccgg

SEQ ID NO: 334114 - DNA, 588 bp, Homo sapiens
  misc_feature: GZ8MTXP02GUXMT.39.5.A05.1.454.CMB.2.raw
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (458)..(458): a, c, t, g, unknown or other
  misc_feature (458)..(458): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcggctaaactggttttctttgtggctatcttggaaggtgtccaatgtgaagtgcaactggtggagtcgtgggggacacgttggcccagccaggccagtccctgacactgtcgtagtaagcgtcgtgggttcgccgtttggtgtatttcgctttggagttgggtgcgccagcgtccacgggaagggcctggagtggtattaggtttaaattagaagtaaactcgtacggnggacagttgaactcgctnattctgtagaagcagtatttacnttctanacgagtatgatagaacctaaaaatctacgtaccttatccttaanaaacttagaacagtctagggaaggaccgacgacagccgacaggtatacgtctcgtagttcgttacgacttacggttcgcgtacgaacccgtaaagttcgacgtaacggtccggggaccggtaattcccgg

SEQ ID NO: 334115 - DNA, 596 bp, Homo sapiens
  misc_feature: GZ8MTXP02G2ZHA.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgcctttggtgtatttcgctttgagttggggtgcgccagagtccgacgggaagggcctggagtggatttggtttaaattagaaagttaaaactcgtaacggtggggacagttagaatacgcctcattctgtagaaagcagtatttaccatcctcacgagatgatagaaccaaaaatactacgacctatactttaacaaattagaaactagcctaggaacggacggacgacacgcgacctagactaatctcttagtcgttacgactacgtttacggccgtacggaaccctaaagttacgaacgaacgtcggggacccggtaacgtccgg

SEQ ID NO: 334116 - DNA, 572 bp, Homo sapiens
  misc_feature: GZ8MTXP02F1DCG.39.5.A05.1.454.CMB.2.raw
  modified_base (321)..(321): a, c, t, g, unknown or other
  misc_feature (321)..(321): n is a, c, g, or t
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtgagtctgggggacacttggcccagccaggccagtccctgacactgtcgtgtaagcgtctgggttcgctttggtgtatttcgctttgagttgggtgcgtccagagtccaggaaggcctggngtggattaggtttaattaggaagtaaaactctacgtgggacagttgaatcgcctnattctgtagaaagcagactttacatctanacgagatgatgaacaaaatactgaccttatcttaacaaatagaacagctagaaggacggacgacgacgcgaccagatacgtactcttgtcgtacgacttacgtttcggaccgttacggaacccgtaaattacgacgtaacggtcggggacccggtaaacgttcccgg

SEQ ID NO: 334117 - DNA, 615 bp, Homo sapiens
  misc_feature: GZ8MTXP02F0YCB.39.5.A05.1.454.CMB.2.raw
  modified_base (312)..(312): a, c, t, g, unknown or other
  misc_feature (312)..(312): n is a, c, g, or t
  modified_base (431)..(431): a, c, t, g, unknown or other
  misc_feature (431)..(431): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacgttggcccagccaggccagtccctgacactgtcgtgtaaagcgtcgtgggttcgtcctttggtgtatttcgtctttggagttgggtgcgccagngtccgacgggaggccgtggagtggtattggtttaaatagaaagttaaaactcgtacgtagggactagttagaatacgcctacattctgtagaaaggcaagtatttaccatctacacganatagatagaaaccaaaatctgacctatacttanaaaatgaaacngacctagggaaccggaaacggacaacgacgaccaaccgaagtacttactacttctgttcgttacggacttacgtttcggccgttacggaaccctaaagttacgaaccggacggtacgggggacccccgtaagtttcccgg

SEQ ID NO: 334118 - DNA, 613 bp, Homo sapiens
  misc_feature: GZ8MTXP02F28EP.39.5.A05.1.454.CMB.2.raw
tcagtcgcactagtcacgaccggtgctcgatttagatagatagacaggggaggtctgggagaggagccccagccgtgagattcccaggagtatccacctggagatcagcactgaacacagaccaccagccatggaattcgggctaaactgggttttctttgtggctatcttggaaggtgtccaatgtgaagtgcaactggtggagtcgtgggggacacgttggcccagccaggccacgtccctgacactgtcgtagtaaagcgtcgtggttcgtccttggtgtatttcgtctttgaggttgggtgcgccgagacgtccgacggaggcctggagtggtatttaggttaaatagtaaagtaaactcgtaacggtggactagttagaactacgcctacatcgtgtagaaagcagtaactttacattctacgacgtagatagtaatacgaaaccctaaaaagtacctcgaacttattaccttaacaaatacgaacagtaccgtaggaacgaggacgaacacgccgacaagactatctcgttgtcgttacacgttcgtttcggaccgttaacggaccctaaagttacgaacgtaaccgggtcggggaacccggtaacg

SEQ ID NO: 334119 - DNA, 554 bp, Homo sapiens
  misc_feature: GZ8MTXP02FF9C9.39.5.A05.1.454.CMB.2.raw
tcagtcgcactagtcacgaccggtgctcgatttagatagatagacaggggaggtctggggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtctgggttcgcctttggtgatttcgctttggagttgggtgcgccagagtccacgggaagggcctggagtggattgggtttaatagaagtaaaactctacgtggacagttgaatacgcctcatctgtgaaaggcagatttaccatctcacgagatgatgaccaaaaatactgcctatcttacaaatgaacagcctaggaggaccggacgacagcgaccagactatactctgtcgttcgactacctttggcgttggaaccctaaattcgacaacgtcgggggaccccggaatcccg

SEQ ID NO: 334120 - DNA, 614 bp, Homo sapiens
  misc_feature: GZ8MTXP02GUJ3T.39.5.A05.1.454.CMB.2.raw
  modified_base (394)..(394): a, c, t, g, unknown or other
  misc_feature (394)..(394): n is a, c, g, or t
  modified_base (433)..(433): a, c, t, g, unknown or other
  misc_feature (433)..(433): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtcgtgggttcgccgtttggtgtatttcgctttgaggttgggtgcgccagagtccgacgggaaggcctggagtggtagtttggtttaaattagaaagttaaactcgtacggtagggactagttagaatacgcctnattctgtagaaaggcaagtactttacatctacacgatangtatagaacaaaaactctacgaccttatacttaactaaatagtaacagtacccgtaggaacggaacggaacgacgacggccgaccagatactctctgtcgttcgacgttacgtttcggccgttacggaaccctaaaagttacggaaccgaacggttaccgggggacccggtaacgttccgg

SEQ ID NO: 334121 - DNA, 591 bp, Homo sapiens
  misc_feature: GZ8MTXP02IEJOH.39.5.A05.1.454.CMB.2.raw
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaacatggaattcgggctaaactgggttttcttgtggctatcttggaaggtgtccaatgtgaagtgcaactggtggagtctgggggacacttggcccagccaggccagtccctgacactgtcgtgtaaagcgtctgggttcgccttggtgatttcgcttgagtggtgcgcagagtccaggaaggctggagtggattggttaaattagaagtaaaactctacgtggacagttanaatacgctcatctgtagaaaaggcagtatttaccattctacacgganaatgatgaccaaaaaaatcgtancctatacttacaaaattcgaaaacacgaccgtaggacgggaaaccggacgaacaaggccgaccgagataacttctactggttagtccgaactacgtttcggaccggtagtaacccccaaaagtttcgaacctaacgtacgggggacccggtaaaacttcccgg

SEQ ID NO: 334122 - DNA, 632 bp, Homo sapiens
  misc_feature: GZ8MTXP02JV2TS.39.5.A05.1.454.CMB.2.raw
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttcttgtggctatcttggaaggtgtccaatgtgaagtgcaactggtggagtcgtgggggacacgttggcccagccaggccagtccctgacactgcgtagtaagcgtgtggttcgtcgttggtgtnttcgcttgngttggtncgcagacgtcgacggaggccgtggagtggtagttggtttaattagtaaagttaaactcgtaacggtgggactagttagaactcgctacgatgtgtagaaacggctaagtatttacccgattctacacgtaagagtagagtagaaacctaaaaatctacgtaccttacttaccgttaaactaaacttacggaacaacggtaccctagggaaccggaacggaaccgaacgacgacccggacaagtataactcctagttcgtacgttccgtacgttacgttcggtacgttacgaacccgtagttaccggaacgtacgggtacggtaccggtactttccgg

SEQ ID NO: 334123 - DNA, 651 bp, Homo sapiens
  misc_feature: GZ8MTXP02GB6Q9.39.5.A05.1.454.CMB.2.raw
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
  modified_base (536)..(536): a, c, t, g, unknown or other
  misc_feature (536)..(536): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtagtaaagcgtgtgggttcgtcctttggtgtatttcgctttggtagttgggtgtcgccgagagtccgacgggaagggcctgggagtggtagtttggtttaaattaggaaagttaaaactcgtaacggtggggacagttagaatacgcctnatctgtagaaaggcaagtactttaaccatcctanaacgagatagatagaaaccaaaaatactagacctaatacttaacaaaatagaaacacgtacctagggaacggaaacggacgaacgacggacgaccaagtanaactctacttcgttacgttacggtaacctaggttttacggccggttacggaacccctaaaaggttacggaaaccgaaaaccggtccggggggaaccccgggtaaacgtttccccg

SEQ ID NO: 334124 - DNA, 643 bp, Homo sapiens
  misc_feature: GZ8MTXP02F6GX8.39.5.A05.1.454.CMB.2.raw
  modified_base (301)..(301): a, c, t, g, unknown or other
  misc_feature (301)..(301): n is a, c, g, or t
  modified_base (409)..(409): a, c, t, g, unknown or other
  misc_feature (409)..(409): n is a, c, g, or t
  modified_base (442)..(442): a, c, t, g, unknown or other
  misc_feature (442)..(442): n is a, c, g, or t
tcagtcgcactagtcacgaccggtgctcgatttagatagatagacagggggaggtctgggagaggagccccagccgtgagattcccaggagtatccacctggagatcagcactgaacacagaccaccaaccatggaattcgggctaaacttgggttttctttgtggctatcttggaaggtgtccaatgtgaagtgcaacgtggtggagtcgtgggggacacgttggcccagccaggccagtccctgacactgtcgtagtaaagcgtcgtgggttcgtccgtttggtgtatttcgctttggnggttgggtgcgccgagacgtcccgacgggaaggccgtgggagtggtatttaggtttaataagaaagttaaaactcgtaaggtggggactagttgaaacgtacgtcctntactctgagaaaggcagtactttaccattctanacgagatgatgaaacaaaatctgaccttatcttaacaaatcgaaacacgtccgtagggaacggaccggaaccacgacggaccgaccgaacgaattactactcgttaggtcgttacgtaccgtacggtttcggccgttaccggaaccttaaacgttcgaaaaccggtaccggtacgggggaccccggggtaactttcccggg

SEQ ID NO: 334125 - DNA, 655 bp, Homo sapiens
  misc_feature: GZ8MTXP02JMHDS.39.5.A05.1.454.CMB.2.raw
  modified_base (280)..(280): a, c, t, g, unknown or other
  misc_feature (280)..(280): n is a, c, g, or t
tcagtcgcactagtcacgaccggtgctcgatttagatagatagacaggggaggtctgggagaggagcccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacgttggcccagccaggccagtccctgacactgtcgtgtaaagcgtctggttcgccgtttggngtattcgcttgagttgggtgcgcagacgtccgacgggaaggcctggagtggtatttaggtttaattagaaagttaaactcgtaggtgggacagttagaatacgctcagttctgtagaaggtctaagtatttaccgattccgacacgtaagagttagaatacgaaacctaaaaacgtactacgtaccttaatacccttaataaacttaacggaaactacgaccgttacgggaaacggaccggaaccgaacgacggacccgaccgaagtactaactcccgttattaggttcgttaccgacgtttacgttcgggtacgtaccgtaacccgtaaagtaccgtaacggaacggtaccgggggacccgggtaacttcccgg

SEQ ID NO: 334126 - DNA, 621 bp, Homo sapiens
  misc_feature: GZ8MTXP02H4RK1.39.5.A05.1.454.CMB.2.raw
  modified_base (280)..(280): a, c, t, g, unknown or other
  misc_feature (280)..(280): n is a, c, g, or t
  modified_base (376)..(376): a, c, t, g, unknown or other
  misc_feature (376)..(376): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaacgtggtggagtcgtgggggacacgttggcccagccaggccagtccctgacactgtcgtgtaaagcgtctgggttcgctttggtnatttcgctttgagttgggtgcgccagagtccgacgggaggcctggagtggatttggtttaatagaagtaaactctacgtggacagtgaatcgcctnatctgtagaaaggcagtatttaccattcctacacgagatagatagaaaccaaaaatctacgacccttatcttacaaattgaaacagtaccgtaggaacggaacggacgaacgacggaccgaccagtaactaacgtccttcgttgttacggttaccgaacgtttccgtttacgggaccggttaccggtaaccctaaaagttacggaaccgtaaaccgggtccgggggaccccggtaacgttcccgg

SEQ ID NO: 334127 - DNA, 646 bp, Homo sapiens
  misc_feature: GZ8MTXP02I6ZC4.39.5.A05.1.454.CMB.2.raw
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (395)..(395): a, c, t, g, unknown or other
  misc_feature (395)..(395): n is a, c, g, or t
  modified_base (437)..(437): a, c, t, g, unknown or other
  misc_feature (437)..(437): n is a, c, g, or t
  modified_base (543)..(543): a, c, t, g, unknown or other
  misc_feature (543)..(543): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcggctaaactgggttttctttgtggctatcttggaaggtgtccaatgtgaagtgcaacgtggtggagtcgtgggggacacgttcggcccagccaggccagtcccngacactgtacgtgtaaagcgtcgtggttcgccgtttggngtagtttcgctttggtagttgggtgccgccgagagtccgaacgggaaggcctggagtggtagttggtttaaatagaaagtaaactcgtacgtggacagttagaactacgcctnactctgtacgaaaggctagtactttacattcctacgacgganattgaaagttcgaaaccaaaacgtacgttcggaacccttatttactttaaacggaaacttacggaacctaagaccccgtgggaaaaggacccggaacgacggaacnccgaaccgtagtataaccgtctcgttgtacgttacgactacgttcggacgttacgaacccgtaaagttacgacgtaacggtcccggggtaccgaactttccgg

SEQ ID NO: 334128 - DNA, 627 bp, Homo sapiens
  misc_feature: GZ8MTXP02JQT8P.39.5.A05.1.454.CMB.2.raw
  modified_base (490)..(490): a, c, t, g, unknown or other
  misc_feature (490)..(490): n is a, c, g, or t
tcagtcgcactagtcacgaccggtgctcgatttagatagatagacagggggaggtctgggagaggagccccagccgtgagattcccaggagtatccacctggagatcagcactgaacacagaccaccaaccatggaattcggctaaactgggttttctttgtggctatcttggaaggtgtccaatgtgaagtgcaacgtggtggagtcgtgggggacacgttggcccagccaggccacgtccctgacactgtcgtagtaagcgtcgtgggttcgccgtttggtgtatttcgtctttgaggttgggtgcgcagagtccgagggacgggcctgggagtggtagtttaggtttaaattaaggaaagttaaactcgtacggtagggactaggttagaagtaccgcctcattctggtagaaaaggccaagtactttaccgattcctacacgagatgaatacgaaacaaaacgtacctagtaccttataccttaanaaactacgaaacgacgcgtagggaacggacggaacgacgacgccgaccgagactactacttcgtgttacgttcgtactcgttacggcgtacgtaaccgtaagttacgacgacggtcggggacccggtacgttcccgg

SEQ ID NO: 334129 - DNA, 592 bp, Homo sapiens
  misc_feature: GZ8MTXP02GD620.39.5.A05.1.454.CMB.2.raw
  modified_base (389)..(389): a, c, t, g, unknown or other
  misc_feature (389)..(389): n is a, c, g, or t
  modified_base (451)..(451): a, c, t, g, unknown or other
  misc_feature (451)..(451): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacttggcccagccaggccagtccctgacactgtcgtgtaaagcgtctgggttcgtcctttggtgtatttcgctttgagttgggtgcgtccagagtccacgggaaggcctggagtggtattggtttaaatagaaagttaaaactcgtacgtaggactagttagaatacgcctanattctgtagaaaggcagtactttacatctacacgagtatgaactagaacccaaaaagttacngtacctatctttaacgaaactgaaacagccgtaggaacggacggacgacagcgacaagatactctagttgtacgttcacgtacgtttcggcgtacggtaaccctaaaagtcgaaacgtaaccgtcggggaccgtacgtccg

SEQ ID NO: 334130 - DNA, 655 bp, Homo sapiens
  misc_feature: GZ8MTXP02HN8OP.39.5.A05.1.454.CMB.2.raw
  modified_base (403)..(403): a, c, t, g, unknown or other
  misc_feature (403)..(403): n is a, c, g, or t
tcagtcgcactagtcacgaccggtgctcgatttagatagatagacaggggaggtctgggagaggagccccagccgtgagattcccaggagtatccacctggagatcagcactgaacacagaccaccaaccatggaattcgggctaaacttgggttttctttgtggtctatcttggaaggtgtccaatgtgaagtgcaactggtggaggtcgtgggggacacgttggcccagccccggccacgtccctgacactgtcgtagtaaagcgtcgtgggttcgtccttggtgtattcgtctttgaggtttgggtgcgccagacgtaccgacgggaagggccgtgggagtggtatttagggtttaatagaagacaaaactctacggtggactagtacgaatacgcctanattctggtagaaagctagtactttaacattcacagagatagatacgaacctaaaatactacgtaccttactacttacaaatacaaacgtacgaccgtaggaacggaaccggggaaccacggacggtacggaccgtaacgtatacttactcgtttacggtacgttaccggtacttacggttcggtaccggtcggtaaccttaaacgtaacgtaccggaaaccggttccggggaacccgggttactttacccgg

SEQ ID NO: 334131 - DNA, 831 bp, Homo sapiens
  misc_feature: GZ8MTXP02IT5UN.39.5.A05.1.454.CMB.2.raw
tcagtcgcactagtcacgaccggtgctcgatttagatagatagacaggggaggtctgggagaggagcccccagccgtgagattcccaggagtatccacctggagatcagcactgaacacagaccaccaaccatggaattcgggctaaactgggttttctttgtggctatcttggaaggtgtccaatgtgaagtgcaacgtggtggagtcgtgggggactacgttggcccagccacgggccacgtccctgaccactggtcgtagtaaagcgtcgtgggttcgtccgtttggtgtatttcggtctttggaggttggggtcgccggccgaggacgttcccgaacggggaacgggtccgtaggggacggttagggtaagtttagggttttaaaactttaaggtaaaacggtttaaaaccgttccgttaacggggttacggggtaacctaaggttttacgaaacgttaccgtacccgttactacgttccgttaggggtaacggaaacgggctaacgttacgttttaccattccgtaacgacggaagtaataggtaacttacgaaaacctaaaacttacgttacgtaccctttaaacgttctttaaaacaaacggtttaacggaaaccctacgggtaccccgttagggggaaaccgggaaccgggaactaacggaccgaaccgtaaccgaagtacttacggtttacctacggttcgttacggtttacccgaactttacgggtttcggggaccggttttcccgaaaaccgtttaacgtttaccggaaaacggtacccgggggtaccgggggtaaccccggttacgttttccccggggg

SEQ ID NO: 334132 - DNA, 866 bp, Homo sapiens
  misc_feature: GZ8MTXP02G909N.39.5.A05.1.454.CMB.2.raw
tcagtcgcactagtcacgaccggtgctcgatttagatagatagacagggggaggtctgggagaggagccccagccgtgagattcccaggagtatccacctggagatcagcactgaacacagaccaccaaccatgaatcgggctaaactgggtttcttgtggctatcttggaaggtgtccaatgtgaagtgcaactggtggagtcgtgggggacacttcggcccagccacggccacgtccctgacactgtcgtgtaaagcgtcgtgggttcgccgtttggtgtatttcgtctttaggtaggtttgggtcgccggtccaaggtacgtcccgaacgggaacggggtccgtagggaggtagggtaagtttaggggttttaaatttaaaggtaaaagttaaaaaccgttccgttaacggtaacggggtacctaaggtttacggaacttacccggtacccttacgtaaacgttccgttacgggttagggaaaacgggtaccgtaaggtaactttttaaccaacgttaccctacgtaaaccgaagtaacgttagtaacgttacggaaaccgtaaaaacttaccttaacgtaccgttactaaccgtttaaacaaaacgttacgaaaacgacggtacccgttagggaaacccgggaaccgggaaaccgaacggaacgaccctaaacccgggtaaacgtaacgttaccgttaccgttacggtttacggttaccggtttaaccgttaacccgttaccggttttaccggggtacccggtttaaacccggtaaacccgttaaaacggttaacccggaaaacccggggtaacccgggggtttacccgggggtaaccccggggttaaccggtttaccccgg

SEQ ID NO: 334133 - DNA, 573 bp, Homo sapiens
  misc_feature: GZ8MTXP01D5ADR.25.35.D02.1.454.CMB.2.raw
  modified_base (374)..(374): a, c, t, g, unknown or other
  misc_feature (374)..(374): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtccaccttccgtcgttttggcattcactgggtccgccaggctccaggcaagggctggagtgggtggcggtcatagtggtggggatggaagtaatgacattttaagngcagactcggtaggaacgggccactcacatccacgagacgcagccaccaactaacctacctttatcgtcgactaattacgaaaccgtgacgacctacgacgaccgacggtctgtctaagttacgtcggcgggtcggggtacttaggaacgaacggtaacggggtccgggccgtcggacggcgtaacggttcgggaaccg

SEQ ID NO: 334134 - DNA, 539 bp, Homo sapiens
  misc_feature: GZ8MTXP01AKRYT.25.35.D02.1.454.CMB.2.raw
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtncttatgacactgtcncctggcaccagtttacccaggaaaacgcccccagagtcatcctttatgatgtcaggaagccggcctcgaggggtccctgactcgcttctctgggtaccaaatctggccaacaccggcctccctgacccatctctgggctccgaggctgaggatgaggctagtattagttattgcttgttcatagtgacaggtcctaaacgtactagttttggtgttcggcgcgacgggtacccttaaggttcgacccgtcgtgggtcacggcccaggtccgttcgtcccccg

SEQ ID NO: 334135 - DNA, 527 bp, Homo sapiens
  misc_feature: GZ8MTXP01EVI7I.25.35.D02.1.454.CMB.2.raw
  modified_base (150)..(150): a, c, t, g, unknown or other
  misc_feature (150)..(150): n is a, c, g, or t
  modified_base (241)..(241): a, c, t, g, unknown or other
  misc_feature (241)..(241): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggntcagtctgccctgactcagcctcgctcagtgtccggtctcctggacagtcagtcaccatctcctgcactggaaccagaagtgatcttggtncttatgacactgtctctggcacctagtttacccagaaacgccccagagtcatccttatgatgtcaggtaagcggcctcgaggggtcccctgactcgtcttctctcgggtaaccaaatcgtggacaaccacggccctccctgaccctatctctcgggctccgaggctgagatgagntgtattagttattgttntntntatntgagacgtactactacttgttgttgttcggtcgcgacggtacgttacgttcgttcgtcgtcggtcgcgcgacgtcgttccgtcccg

SEQ ID NO: 334136 - DNA, 523 bp, Homo sapiens
  misc_feature: GZ8MTXP01D9N7H.25.35.D02.1.454.CMB.2.raw
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (470)..(470): a, c, t, g, unknown or other
  misc_feature (470)..(470): n is a, c, g, or t
tcagactgtacagtcacgaccggtgctcgatttagcacacgatagttgggtttgggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtcgttttggcattcactgggtccncaggctccaggcaagggctggagtggtggcgtcatagtggtgggatggaagtaatgcattttgngcagactcggagacggccacncacntcncagagcagcacaanactactttancgtagactaatacgaaaccgtgacgactacgacgacacgctgtctattcgnggcggtcgggtcagaagacgtgggtccgggccgtcgacggcgtcgttcggccg

SEQ ID NO: 334137 - DNA, 610 bp, Homo sapiens
  misc_feature: GZ8MTXP01BDC0A.25.35.D02.1.454.CMB.2.raw
  modified_base (265)..(265): a, c, t, g, unknown or other
  misc_feature (265)..(265): n is a, c, g, or t
  modified_base (392)..(392): a, c, t, g, unknown or other
  misc_feature (392)..(392): n is a, c, g, or t
  modified_base (473)..(473): a, c, t, g, unknown or other
  misc_feature (473)..(473): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggaggcgtggtccaggccggggaagtccctgagactctcctgtgcngtcgtccgcgtccaccttcgtcgtttgctattcacgtcgggtcccgccaggcctccgaggcgaagggctgggagtgggtggcgtcagtagtgggtagggatagggaagtaatgacttaattttaagngaccagacctccggtaggaaacggggcccactcacctatcctccgagacggcagcctaccgaaagtaacctaccttttacncgtacgaactaaagttaacgaaaccgtgaacgaccgtacgacctacgtacgtcttagtaacttagttcgtggcgggtcgggtacaggaacgacgggtcgggtccgggtccgtacggacggacgtcggttcggaaccg

SEQ ID NO: 334138 - DNA, 602 bp, Homo sapiens
  misc_feature: GZ8MTXP01CUY9Z.25.35.D02.1.454.CMB.2.raw
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
  modified_base (454)..(454): a, c, t, g, unknown or other
  misc_feature (454)..(454): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggaggcgtggtccaggccggggaagtccctgagactctcctgtgcagtgtccgcgtccaccttccgtcgtttggctattcacgtgggtcccnccaggcctccgaggcaaggggctgggaggtgggnggcggtcagtagtgggtgggatggaagtaatgactatttngacagactccggtagacgggcccactcaccatcctccagacggcacgcctaccaaagtactaccttttancgtagactaagtaacgaaacgtgaacgacgtacgacgtacgacggtctgtaaccttaagttcgtcggaccgggtcggggtacaacgggaacggaaccgggtcgggggtcccgggtccgtacgaccgggacgtaacggttcgggaaccg

SEQ ID NO: 334139 - DNA, 607 bp, Homo sapiens
  misc_feature: GZ8MTXP01D0WTJ.25.35.D02.1.454.CMB.2.raw
  modified_base (340)..(340): a, c, t, g, unknown or other
  misc_feature (340)..(340): n is a, c, g, or t
  modified_base (373)..(373): a, c, t, g, unknown or other
  misc_feature (373)..(373): n is a, c, g, or t
  modified_base (446)..(446): a, c, t, g, unknown or other
  misc_feature (446)..(446): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtccaccttcgtcgttttgctattcacgtgggtcccgccaggctccaggcaagggctggagtgggtgcggtanagtgtggtggataggaatatcgtacttatttgngacacgtacgtcggtaggaacgggccactcacatccgtacgaggacgcacgcctacaaactaacttactttanacgtacgactaaagttacgaaacgtgacgtacgtacgacgtacgacggtctcgtaacttaacgttcgtcgggccgggtacggggtacttaacgggaaacggttaccggtcgggggtcccggggtcccgttacggaccgggcgtaacggttcggggaacccg

SEQ ID NO: 334140 - DNA, 543 bp, Homo sapiens
  misc_feature: GZ8MTXP01EN418.25.35.D02.1.454.CMB.2.raw
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccacctccgtcgtttgcattcactggtccnccaggctccaggcgaggactggagtgggtgcggtcagtatgggtggatggaagtaatgctaattttagngcagactcggtagacgggccactcacatcncagagcacgcacaanactacttatctagactaagtacgaaacgtgagacgtacgacgacgtacgctcgtctaattcgcggcggcgggtctaaggaacggacgttacggggtcggggcctcggtacggcacggtcggaaccgtcgg

SEQ ID NO: 334141 - DNA, 564 bp, Homo sapiens
  misc_feature: GZ8MTXP01BEGNC.25.35.D02.1.454.CMB.2.raw
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (442)..(442): a, c, t, g, unknown or other
  misc_feature (442)..(442): n is a, c, g, or t
  modified_base (524)..(524): a, c, t, g, unknown or other
  misc_feature (524)..(524): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtccaccttccgtcgtttggctattcacgtgggtcccgccaggctccgaggcaagggctggagtgggtggcggtcagtagtggtggatggaagtatgactattttgngcagtacgtcggtaggacgggccactcaccatccncgagacgcagcctacaagtaccttactttancgtagactaagttacgaaacgtgacgacgtacgacgtacgacgtctgtctagttcgtggccggtacgggtcaggacgacggnggggtccgggccgtacgacggcgtaacggttcgggaaccg

SEQ ID NO: 334142 - DNA, 604 bp, Homo sapiens
  misc_feature: GZ8MTXP01CISS7.25.35.D02.1.454.CMB.2.raw
  modified_base (313)..(313): a, c, t, g, unknown or other
  misc_feature (313)..(313): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (451)..(451): a, c, t, g, unknown or other
  misc_feature (451)..(451): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtcagtgtcagatgcaactggcggaggtcggggggagcgtggtccaggccggggaagtccctgagactctcctgtgcagtcgtcccgcgtccaccttccgtcgtttggctattccacgtcgggtcccnccaggcctccgaggccaaaggggctggaggttggggtgggcgtcagtagtgggtagggataggaagtaatgactattttngtnagctccgtaggaacggccactcacatcnccagagcagctacaaagactactttanctgactaattacgaaaaccgttgacgtactacgaacgacgacggtctgtaaccttaattcgtcggaccgggtcggggttaccagggaacggaaacggtcgggggtcccggggaaccgttcggtaaccgggcgtaacgttcggggaaccccggg

SEQ ID NO: 334143 - DNA, 750 bp, Homo sapiens
  misc_feature: GZ8MTXP01DS2NJ.25.35.D02.1.454.CMB.2.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtgggcggaggtcgggggagcgtggtccaggccggggaatccctgagactctctgtgcagtcgtccgcgtccacctcgtgtttgctattcacgtcggtccnccaggcctccgaggcaaagggctggaggtgggtggcggtanagtagtgggtaggagtaggaaagtagtcgtacttaaagtttagcgacgtaacggtacccgttaccgggtagggaaccggggtccctaacctacccaacctacgttcccgtaaccgaaggacggtaccaacgtaccctaaacccgaaacgttaaaccctttaaccttttaacgtaccgttaacgggtaaacttaaacgtttaaaccggaaaacccggtgtaaaccgtaccgtaacggaacccgtaccgtaccggtacttacgttacttaacgttaccggttcgggtaccgggttacggggtaacgtaacgggttaaacggttaccgggttaccgggggttcccggggtacccgttaacgggtaaccgggacgttacggggttaaccggggaaccccgggtcccggg

SEQ ID NO: 334144 - DNA, 621 bp, Homo sapiens
  misc_feature: GZ8MTXP01EV7WB.25.35.D02.1.454.CMB.2.raw
  modified_base (386)..(386): a, c, t, g, unknown or other
  misc_feature (386)..(386): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggaatccctgagactctcctgtgcagtgtccgcgtccaccttccgtcgtttggctattcacgtcgggtcccgccaggcctccgaggcaaaggggactgggagtggggtggcggtcatagtggtgggatggaagtaatgactattttaangcagactccggtaggaacgggccgactcaccatcctccagaggcagcctaccaagaacctacctttagctgactaaattacgaaaaccgtgacgacctacgacgaccacgggtctggtcttaacgtttacgtcggccgggtaccgggggtccttaaggaacggttaaccgtaacggggggttccgggggtaaccccgttccggtacgggaccgtaaggttccggggaaccccggg

SEQ ID NO: 334145 - DNA, 620 bp, Homo sapiens
  misc_feature: GZ8MTXP01ETYQB.25.35.D02.1.454.CMB.2.raw
  modified_base (393)..(393): a, c, t, g, unknown or other
  misc_feature (393)..(393): n is a, c, g, or t
  modified_base (425)..(425): a, c, t, g, unknown or other
  misc_feature (425)..(425): n is a, c, g, or t
  modified_base (460)..(460): a, c, t, g, unknown or other
  misc_feature (460)..(460): n is a, c, g, or t
  modified_base (531)..(531): a, c, t, g, unknown or other
  misc_feature (531)..(531): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcgggaggtcggggggagcgtggtccaggccggggaatccctgagctctcctgtgcagtcgccgcgtccaccttccggtcgtttgctattcacgtcgggtccgccaggcctccgaggcaaaggggcgtgggagggtggggtcggcgtcagtagtgggtaggatagggaatatgaacttattttgngacacgtacgtcggtaggacggccactacacnctcacgagacgcagccacaactaaccttactttancgtacgtactaaagtacgaaaccgtgaacgtacgtacgaacgtaccgtacgtctgtaacttaacgttcggnggttccgggtacggggtacttaggaacggttacgggtcggggtcccgggtccgttacggaccggttacgtaacgggttccgggaaccgg

SEQ ID NO: 334146 - DNA, 564 bp, Homo sapiens
  misc_feature: GZ8MTXP01DHE8L.25.35.D02.1.454.CMB.2.raw
  modified_base (385)..(385): a, c, t, g, unknown or other
  misc_feature (385)..(385): n is a, c, g, or t
  modified_base (439)..(439): a, c, t, g, unknown or other
  misc_feature (439)..(439): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttccctcgttgcttcttttaagaggtgtccagtgtcagatgcaacgtggcggaggtcgggggagcgtggtccaggccggggaatccctgagactctcctgtgcagtgtccgcgtccaccttccgtcgtttggctattcacgtgggtcccgccaggcctccgaggcaaggggactgggaggtgggtggcgtcagtagtgggtggatggaagtaatgactattttngcagactcgtagacgggccactcacatcacagagcagctacaagactactttancgtagactaattacgaaacgtgacgactacgacgtacgacgtctgtctattacgtggcggtacgggtacttaggaacgaacggtcggggtccgggccgtacgtacggactggttcggaacccggg

SEQ ID NO: 334147 - DNA, 568 bp, Homo sapiens
  misc_feature: GZ8MTXP01C1F1X.25.35.D02.1.454.CMB.2.raw
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
tcagactgtacagtcacgaccggtgctcgatttagcacacgatagttgggtttggggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcacatctcctgcactggaaccagaagtgatcttggtncttatgacactgtcncctggcaccagtttacccaggaaacgccccagacgtcatccttatgatgtcaggaacgcggcctcgacggggtcctgactcgcttctctggtaaccaaatcgtaggaccaaacgaccggccctccctcgaccctactctcgttcgggcctccgaggcctggaggtagtggagtctagtatttagttatgtcttgttcatatgacaggtactaactacttagtttcggtgtttcggcgcgtaacgggaccgttaaaggttcgacccgttccgtagggtccacggacccgttaacggtcccgttccgtcccccg

SEQ ID NO: 334148 - DNA, 563 bp, Homo sapiens
  misc_feature: GZ8MTXP01CGCSY.25.35.D02.1.454.CMB.2.raw
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (379)..(379): a, c, t, g, unknown or other
  misc_feature (379)..(379): n is a, c, g, or t
  modified_base (448)..(448): a, c, t, g, unknown or other
  misc_feature (448)..(448): n is a, c, g, or t
  modified_base (533)..(533): a, c, t, g, unknown or other
  misc_feature (533)..(533): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtcccaccttccgtcgtttggcattcactgggtcccnccaggctccaggcaagggctgggagtggggnggcggtcatagtgggtcgggatgggaaagtatgactattttngcagactccgtagaacgggcccactcaccatcctccagacggcagcctaccaaagaacctaccttttanccgtgtactaaagttagaaaaccgtgaacgactacgacgacacggtctggtctaattcgtcgcggtcggggtcttaggagaacgngggtcgggctcgacggctaagttggaaccg

SEQ ID NO: 334149 - DNA, 546 bp, Homo sapiens
  misc_feature: GZ8MTXP01COJP6.25.35.D02.1.454.CMB.2.raw
tcagactgtacagtcacgaccggtgctcgatttagcacacgatagttgggtttggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgcttatgacactgtctcctggcaccagttttacccaggaaaacgcccccagagtcatcctttatgatgtcaggaacgcggccctcgacgggtccctgacctcgcttctctgggtaccaaatcgtggcaacgaccggcctccctgacccatctctcgggctcaggctgaggatgagctgtattagttattgtctgttcatatgccagtctaactacttagttttggtcgttcgggcgacgtacgggccttaaggttcggacccgttccgtaggggtccacggtcccgaagggtccgttcgtcccccg

SEQ ID NO: 334150 - DNA, 685 bp, Homo sapiens
  misc_feature: GZ8MTXP01DH8S9.25.35.D02.1.454.CMB.2.raw
  modified_base (404)..(404): a, c, t, g, unknown or other
  misc_feature (404)..(404): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcggggggaggcggtggtccaggccggggaagtccctgagactctcctgtgcagtcgtccgcgtcctacctcgtcgtttggctattcacgtcgggtccgccgaggcctccgagggcaaagggggactgggagtggggtcggcggtcagtagtggggtgggtatagggaaagtaatggacttaaatttttagnggacctaaggtacccgtcccggtaggaaacggggcccgtaactccgaacctatcctacccgaggacggaccacggtcccttaaccgaaagtaaaccctaccttttaagccttacgggaacctaaagtttaacgaaaaccggttgaacgtaccgtacggaaccgacgtacggtctgtcctaagttcgttaggccggttacggggtacctaggaaaacggttaccggttagggggtcccggggccgttccgtacggggcacggttcgggaaccggtcccgggg

SEQ ID NO: 334151 - DNA, 564 bp, Homo sapiens
  misc_feature: GZ8MTXP01CXOXR.25.35.D02.1.454.CMB.2.raw
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
  modified_base (443)..(443): a, c, t, g, unknown or other
  misc_feature (443)..(443): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactgggcgggaggtcggggggaggcgtggtccaggccggggaagtccctgagactctcctgtgcagtgtccgcgtccaccttcgtcgtttgctattcacgtggtccncaggctccaggcaagggctgggagtgggngcggtnagtagtgggtggatggaagtatgacttattttncgacagtactccggtaggaacgggcccactcaccatctccagagcagcctacaagactacttttacncgtagactaatacgaaacgtgacgactcgacgacgacggtcttgtctagttcgtcggcgggtcgggtcaaggacggacggtcggggtccgggtccgtcgacggccgtggttccgggaaccg

SEQ ID NO: 334152 - DNA, 660 bp, Homo sapiens
  misc_feature: GZ8MTXP01BV2Y6.25.35.D02.1.454.CMB.2.raw
  modified_base (241)..(241): a, c, t, g, unknown or other
  misc_feature (241)..(241): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctctgcactggaaccagaagtgattcttggtncttatgactactgtctccgtggcaccgtagtttacccgaaggaaaccgcccccagacgtctaacttccttatgtatgtacgaggaacgccggcctacgacgggtccctgacctcgtcttcgtcgtggtaaccaaatcgtaggaccaacgaccggtccctcccgtacgaccacttccgtcggtcgggtccttacccggagggtacccgtacgggtaacgggtagttacgggaacgggtccttagggttaaactttacgggtttaagtttcggtaccgtttaggttacctattaacgtcggtaaccgtaggtaacctaaacttacgttaagttttcgggtacgtttcggggcgttacggtacggtacttaacggttcgaccgttcgtcgggtcacggccgttacgtccgttccgtcccccg

SEQ ID NO: 334153 - DNA, 596 bp, Homo sapiens
  misc_feature: GZ8MTXP01EYOT9.25.35.D02.1.454.CMB.2.raw
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
  modified_base (522)..(522): a, c, t, g, unknown or other
  misc_feature (522)..(522): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaatccctgagactctccgtgtgcagtcgtccgcgtcccaccttccgtcgtttgctattcacgtggtccncaggctccaggcaagggctggagtgggtgcggtnagtagtgggtcggatggaagtaatcgaactattttaagngcagtacctccggtaggaacggggtcccactcaccatcctccagacggcagcctaacgaanaactaccttttancgtacgataaacgttacgaaaaccgtgacgactacgaacgacgtacggccttgtccttaagtttacgnggacggtcggggtacttaggaacggacgtaaggggtccgggtccttacgacggacctaaggttcgggaacccgg

SEQ ID NO: 334154 - DNA, 606 bp, Homo sapiens
  misc_feature: GZ8MTXP01EGG7F.25.35.D02.1.454.CMB.2.raw
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
  modified_base (440)..(440): a, c, t, g, unknown or other
  misc_feature (440)..(440): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggagtcggggggagcgtggtccagccggggaatccctgagactctcctgtgcagtcgtccgcgtccaccttccgtcgtttggcattcactgggtccncaggctccaggcaagggctgggagtgggtgcggtnagtagtggtggatggaaagtaatgactaattttagngacacgtacgtcggtaggacgggcactcacatcncgagagacacgctacaagtaccttactttanctagaactaagttaacgaaacgtgaacgtactacggaacgacgtacggtcttacgttactaacgttcgcgggtaccgggttacgggtacgtaagggaaacggttaccggttacggggtcccgggtaccgtaacggtacggcgttacggtccgggaaccggtccggg

SEQ ID NO: 334155 - DNA, 546 bp, Homo sapiens
  misc_feature: GZ8MTXP01CV6VB.25.35.D02.1.454.CMB.2.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (436)..(436): a, c, t, g, unknown or other
  misc_feature (436)..(436): n is a, c, g, or t
tcagactgtacagtcacgaccggtgctcgatttagcacacgatagttgggtttgggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctctgcactggaaccngaagtgatcttggtncttatgacactgtctcctggcacctagttttacccaggaaaacgcccccagagtcatcctttatgatgtcaggaagcggcctcgaggggtccctgactcgcttctcgtggtacccaaatctgggcaaccgacggcctccctgacccatctcgtgggctccgaggctgagatgagctgattatattgctgtcatatgcngtctaacgtctagtttggtgttcggtcgcgtaacggggcttaaacggttcggaacccgttccgttagggggttccaacgggcccgaaacggggtccttcggtcccccccg

SEQ ID NO: 334156 - DNA, 612 bp, Homo sapiens
  misc_feature: GZ8MTXP01CEIV3.25.35.D02.1.454.CMB.2.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
  modified_base (428)..(428): a, c, t, g, unknown or other
  misc_feature (428)..(428): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaatccctgagactctcctgtgcagtgtccgcgtccacctccgtcgtttggctattcactgggtcccnccaggctccgaggcaagggactgggagtgggtggcggtnatagtggttgatggaatatgctaatttangcagctcgagacggccactcacatcacagacgcacgctacaacgtacctactttanctaggactaagttacgaaaccgtgaacgaccgtacggaacgacgtacggtcttacgtacttaacgttacgttcgggaccgggttacggggttactaagggaaacggttaccggttcgggggttaacccggggtacccgttaacggtaaccgggacgttacgggtccggggaacccgggtccggg

SEQ ID NO: 334157 - DNA, 614 bp, Homo sapiens
  misc_feature: GZ8MTXP01CDQ3V.25.35.D02.1.454.CMB.2.raw
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (435)..(435): a, c, t, g, unknown or other
  misc_feature (435)..(435): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactgggcggaggtcggggggaggcgtggtccaggccggggaagtccctgagactctcctgtgcagtcgtccgcgtccacctcgtcgtttgctattcactgggtccncaggcctccgaggcaagggctgggaggtggggtggcggtcagtagngggtggatggaagtatgctaattttangcagactcgagacgggccactcacatcncagacgcagctacaagactactttanctgtactaagttacgaaaaccgtgaacgtactacggaacgaccgtacggtcttacggttctaacgttaccgttgggtaccgggttcgggggttacctagggaaaacggttaccggttacgggggttcccgggggcccgttaacgtaccggggcttaacgggtcgggaaccgtcccgggg

SEQ ID NO: 334158 - DNA, 605 bp, Homo sapiens
  misc_feature: GZ8MTXP01AU3LY.25.35.D02.1.454.CMB.2.raw
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccgaggccggggaatccctgagactctcctgtgcagtcgtccgcgtcccaccttcgtcgttttgctattcacgtcggtcccnccaggcctccgaggcaagggctggagtgggnggcgtnagtagnggtggataggaagtatgactagtttngacagtacctcggtagaacgggcccactcgacctatcctccgaagacggcacgtcctaccaaagtaacctaccgttttancggtanactaagtaacgaaacgtgacgacgacgacgtacgcgtctgtaactacgttcgcgttaccgggtacggtattaacggaacgaccgggtaacggggtcccgggtaaccgtacggacggacgtaacggttccgggaaccgg

SEQ ID NO: 334159 - DNA, 604 bp, Homo sapiens
  misc_feature: GZ8MTXP01DIF06.25.35.D02.1.454.CMB.2.raw
  modified_base (307)..(307): a, c, t, g, unknown or other
  misc_feature (307)..(307): n is a, c, g, or t
  modified_base (345)..(345): a, c, t, g, unknown or other
  misc_feature (345)..(345): n is a, c, g, or t
  modified_base (383)..(383): a, c, t, g, unknown or other
  misc_feature (383)..(383): n is a, c, g, or t
  modified_base (467)..(467): a, c, t, g, unknown or other
  misc_feature (467)..(467): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcggaggtcggggggagcgtggtccgaggccggggaatccctgagactctcctgtgcagtgtccgcgtcccaccttccgtgtttgcattcacgtgggtccnccaggcctccgaggcaagggctggagtgggtggcggtnagtagtggtgggactgggaaatagtcgataaattttangacaagtaccttccgaggaacggggccctactacacctatcccgtacaaggacggctacgcctaccaaagaccttaccttttanctacgaactaaagtacgaaaccgtgacacgacgacgacgtcggtntcgtntaacgtcgcgggacggttcgggtactaaggaacgggacggcggggtcccgggccgtcgaccgggacgttacggtccgggccgccggg

SEQ ID NO: 334160 - DNA, 625 bp, Homo sapiens
  misc_feature: GZ8MTXP01A1S1S.25.35.D02.1.454.CMB.2.raw
  modified_base (310)..(310): a, c, t, g, unknown or other
  misc_feature (310)..(310): n is a, c, g, or t
  modified_base (388)..(388): a, c, t, g, unknown or other
  misc_feature (388)..(388): n is a, c, g, or t
  modified_base (477)..(477): a, c, t, g, unknown or other
  misc_feature (477)..(477): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggagcgtggtccaggccggggaatccctgagctctcctgtgcagtcgtcccgctcccaccttccgtcgtttggctattccacgtgggtcccncaggctcgaggcaagggctggagtgggtggcggtcagtagtgggtaggatagggaaatatggaacttatttttaacgngacacgtaccgtcggaggacgggccctactaccacctactccgaccgaggacgacacgacctaaccgaaacgtaaccttaccttttacncggtacgtaactaaacgttaacggaaaccgtgaacgtaccgtacgaccgtaccgacggtctcgtaacttacgttacgcggccgggtcgggtacaggaacggacggtcggggtccgggtccgtacgacggcgtaacggttcgggaaccg

SEQ ID NO: 334161 - DNA, 588 bp, Homo sapiens
  misc_feature: GZ8MTXP01AEP0B.25.35.D02.1.454.CMB.2.raw
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
  modified_base (456)..(456): a, c, t, g, unknown or other
  misc_feature (456)..(456): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggagtcgggggagcgtggtccagccggggaagtccctgagactctcctgtgcagtcgtccgcgtcccaccttccgtcgtttgctattcacgtgggtcccnccaggcctccgaggcaagggctggagtgggtgcggtcagtagtgggtggatggaataactgactattttngcagacctccggtagaaacgggcccgactcaacccatcctaccgagacggcagcctaccaaagtaacctaccttttancgtagactaacgtaacgaaacgtgacgacgtacgacgtacgacgtctgtctacgttcggcggccgggtcgggtcttacggaacgttacggcggggtccggtccgtacgtacggactaacggttcgggaaccg

SEQ ID NO: 334162 - DNA, 576 bp, Homo sapiens
  misc_feature: GZ8MTXP01DXU0B.25.35.D02.1.454.CMB.2.raw
  modified_base (150)..(150): a, c, t, g, unknown or other
  misc_feature (150)..(150): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggntcagtctgccctgactcagcctcgctcagtgtcccgggtctcctggacagtcagtcaccatctcctgcactggaaccagaagtgattcttggtgcttaatgacactgtctcctggcacctagtttacccaggaaacgccccagagtcatcctttatgatgtacaggaagccggcctcgacggggtcctgactcgcttctctggtaacccaaatcgtggacctaaacgaccggccctccctgaccctatctcgtggcctccagactgaggatgaggtctagtatttagttattggtctttagttctatagtagtacgtacgtactaacttacgttgtttggttcggttcggtcggttacgtacggtaacgttacggttcgttaccggtccggtcggtcgaccgaccgaccgtccgttcccgtccccg

SEQ ID NO: 334163 - DNA, 607 bp, Homo sapiens
  misc_feature: GZ8MTXP01EG5T5.25.35.D02.1.454.CMB.2.raw
  modified_base (248)..(248): a, c, t, g, unknown or other
  misc_feature (248)..(248): n is a, c, g, or t
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
  modified_base (457)..(457): a, c, t, g, unknown or other
  misc_feature (457)..(457): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccgggaatcctgagactntcctgtgcagtgtccgcgtccaccttcgtcgtttggctattcacgtggtccgccaggctccgaggcaagggctggagtgggtgcggtanagtgtggtggataggaagtatgtaacttatttgngacgacgtacgtcggtaggacgggcctactaccacctactcctacgaggacggacacgtaccaacgaaacgtaaccttacctttanacgttacgtaactaaacgttaacgaaaaccgtgaacgaccgtacgacgtacgacggttctcgtaacttacgttcgtcggcgggtcgggtacaaggaacggacggtcgggggtccgggtccgtacggacggacgtaacggttcgggaaccg

SEQ ID NO: 334164 - DNA, 624 bp, Homo sapiens
  misc_feature: GZ8MTXP01B5X0Q.25.35.D02.1.454.CMB.2.raw
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
  modified_base (393)..(393): a, c, t, g, unknown or other
  misc_feature (393)..(393): n is a, c, g, or t
  modified_base (429)..(429): a, c, t, g, unknown or other
  misc_feature (429)..(429): n is a, c, g, or t
  modified_base (466)..(466): a, c, t, g, unknown or other
  misc_feature (466)..(466): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcggggggagcgtggtccaggccggggaatccctgagactctcctgtgcagtcgtccgcgtcccaccttcgtcgtttggcattcacgtgggtccnccaggcctcgaggcaagggctgggagtgggnggcggtcagtagtgggtagggatagggaaagtaatggtaacttatttttgngacagtacgtccggagggaacgggcccactcacctntcctcgagacgcacgccacaacgtaaccttactttancgtagtactaagttacggaaaccgtgaacgaccgtacgacgacgtacgtcttgtaacttacgttacgtcggaccgggtcgggttacgaacgggaacggttaccgggtcgggggtacccgggtccgttacggtaccgggacgtcgggttccgggaaccg

SEQ ID NO: 334165 - DNA, 642 bp, Homo sapiens
  misc_feature: GZ8MTXP01E3OQX.25.35.D02.1.454.CMB.2.raw
  modified_base (382)..(382): a, c, t, g, unknown or other
  misc_feature (382)..(382): n is a, c, g, or t
  modified_base (453)..(453): a, c, t, g, unknown or other
  misc_feature (453)..(453): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtccaccttccgtcgtttggcattcacgtgggtcccgccaggctccgaggcaaggggctgggagtggggtggcggtcagtagtgggtgggatgggaaagtatgaactattttaangcagactccggtgaacgggcccactcaccatctaccagaggcacgctaccgaaacgaacctaccgttttancgtagacctaaattacggaaaaacccgtgaacgtaccgtacgaccgaacgacggtctggtaacttaacgttaccgtcgaccgggtcgggggttaaccttaggggaaacgaaaccgggtaaccgggggttaccgggggaaccccggttacggttaacccggggacgtaaccggttcgggggaaccccggg

SEQ ID NO: 334166 - DNA, 584 bp, Homo sapiens
  misc_feature: GZ8MTXP01AP3UL.25.35.D02.1.454.CMB.2.raw
  modified_base (381)..(381): a, c, t, g, unknown or other
  misc_feature (381)..(381): n is a, c, g, or t
  modified_base (444)..(444): a, c, t, g, unknown or other
  misc_feature (444)..(444): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccaggccggggaagtccctgagactctcctgtgcagtgtccgcgtccaccgttccgtcgtttggcattcactgggtcccgccaggctccgaggcaagggctggagtgggtggcggtcagtagtgggtggatggaagtatggactattttaagngacagtacgtcggaggacggccactcacatcacgagacgcacgcctacaacgtactactttancgtacgactaacgtacgaaacgtgaacgtaccgtacgacgtacgtacggtctgtcttaacgttcgtcggccgggtacgggtacttaggaacgttacgggcggggtccgggtccgtacggtacggactcggttcgggccgg

SEQ ID NO: 334167 - DNA, 592 bp, Homo sapiens
  misc_feature: GZ8MTXP01EN0DB.25.35.D02.1.454.CMB.2.raw
  modified_base (301)..(301): a, c, t, g, unknown or other
  misc_feature (301)..(301): n is a, c, g, or t
  modified_base (377)..(377): a, c, t, g, unknown or other
  misc_feature (377)..(377): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggagtcgggggagcgtggtccagccggggaatccctgagactctcctgtgcagtgtccgcgtccactccgtcgtttggcattcactcgggtccnccaggctccgaggcaagggactgggagtgggtggcggtcagtagtgggtagggatgggaataatgctaattttagngcagcgtcgaggacggcactcacatcacgagacgcacgactacgaacgtaacctactttatctacggtaactaaagttacgaaacgtgaacgacgtacgaacgacgtacgtcttcgtacttaagttacgttcggcgggttcgggtactaaggaacggacggttacgggggtccgggtccgtaacggtacggcgttacggtcgggaaccgtccggg

SEQ ID NO: 334168 - DNA, 736 bp, Homo sapiens
  misc_feature: GZ8MTXP01AETEF.25.35.D02.1.454.CMB.2.raw
  modified_base (646)..(646): a, c, t, g, unknown or other
  misc_feature (646)..(646): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcgggaggtcggggggaggcggtggtccgaggccggggaagtccctgagactctcctgtgcagtcgtccgcgtcctaccctccgttcgtttggctattcgacgtcgggtcccgccgacggcctccgagggaccgaaggggacgtggggaggttgggggtcggcggtcagttagtggggtaggggataggggaaagttaagtcggtacttaaagtttttagcggacgaaacggtaccgttacccgggtagggaaacgggggccccaaaccttcccgaacctacttcccgtaccgaaggacgggaccaacggtccctaaaccaaaacgtaaacccttaccctttttaatccgtacgggtaactaaaacgtttacggaaaaacccgttggaaactacccgtaccggaaacgtaccgtacggtctacggttcctaacgtttcgnggccgggttacggggtactaagggaacgttaacccggttgggggtaaccgggtcctcgtacgggccttagcggggttaacccgtccgggg

SEQ ID NO: 334169 - DNA, 622 bp, Homo sapiens
  misc_feature: GZ8MTXP01BJC7Z.25.35.D02.1.454.CMB.2.raw
  modified_base (309)..(309): a, c, t, g, unknown or other
  misc_feature (309)..(309): n is a, c, g, or t
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggagcgtggtccaggccggggaatcctgagactctcctgtgcagtcgtccgcgtccaccgttccgtcgtttggctattcacgtgggtccnccaggcctcgaggcaagggctgggagtgggtggcggtcagtagtgggtggatgggaagtatgactattttngcagcctcgtaggacggcccactcgaccatctaccgagacggctagcctaccgaaagtacctacttttancgtacgtactaagttacgaaaaccgtgaacgaccgtacggaaccgacgtaccggtctcggttaacttaagttaccgtcggccgggttccggggtacttacgggaaacggaccggtaacgggggtcccggggtccgttacggaccgggaccgtaagttccggggaaccccggg

SEQ ID NO: 334170 - DNA, 589 bp, Homo sapiens
  misc_feature: GZ8MTXP01BOAE4.25.35.D02.1.454.CMB.2.raw
  modified_base (311)..(311): a, c, t, g, unknown or other
  misc_feature (311)..(311): n is a, c, g, or t
  modified_base (387)..(387): a, c, t, g, unknown or other
  misc_feature (387)..(387): n is a, c, g, or t
  modified_base (462)..(462): a, c, t, g, unknown or other
  misc_feature (462)..(462): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggaggtcgggggagcgtggtccaggccggggaatccctgagactctcctgtgcagtgtccgcgtcccaccttccgtcgttttggctattcacgtgggtcccnccaggctccgaggcaagggctggagtggggtggcggtcagtagtgggtgggatgggaagtaatgactattttaagngacaggacctccggtggaaacggggcccgactccgaccatctccagaggcagcctacaaagtacctacttttacncgtacgtactaagtacgaaaccgtgacgacgtacgacgtacgacgtctgtaactacgttcgcggccggtcgggtcacggacggacggtcggggtccgggccgtcggacggcgtcggttcgggaaccg

SEQ ID NO: 334171 - DNA, 606 bp, Homo sapiens
  misc_feature: GZ8MTXP01C2KW9.25.35.D02.1.454.CMB.2.raw
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcaggcgcatctggtggagtcgtgggggagcgtggtccagcctgggaacgtccccgagctctcctgtgtgcgctagactcaccttnagtagttatggcttcgtcgtcgggtcccncctaggtcgtcccgaagggcgaagggggctggggagtggcgtggggatttacgttggtctgacagaacaaaatgaactatatcgacggcgggagtccggnggacgggcgactcaccgactcgtacgagggactaactaccaaacgaacgaaccctctactctacgacaaactacgaactaacgttagaagtacgtacggaaggtacgtaaccggtaacgtttaacttacgttcgttacgtaccgtaccgttacgaggaggtaaggacgtaaggaaagtcgttagtccttcgtaaccg

SEQ ID NO: 334172 - DNA, 554 bp, Homo sapiens
  misc_feature: GZ8MTXP01E4J43.25.35.D02.1.454.CMB.2.raw
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (426)..(426): a, c, t, g, unknown or other
  misc_feature (426)..(426): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaatccctgagactctcctgtgcagtcgtccgctcccaccttccgtcgtttggcattcacgtgggtcccnccaggctccgaggcaagggctggagtgggtgcgtnatagnggtggatggaagtatgactatttgngtagactcgngaacgggccactcacatcncagngcagctacaagactactttanctagactaagtacgaaacgtgacgactacgacgactcggtctcgtctaagtcgcggcggttacgggtactaaggaacggacggacggggtcccggggacgtcgacggcgacggtcgggaaccgtccgg

SEQ ID NO: 334173 - DNA, 611 bp, Homo sapiens
  misc_feature: GZ8MTXP01ASA3P.25.35.D02.1.454.CMB.2.raw
  modified_base (348)..(348): a, c, t, g, unknown or other
  misc_feature (348)..(348): n is a, c, g, or t
  modified_base (382)..(382): a, c, t, g, unknown or other
  misc_feature (382)..(382): n is a, c, g, or t
  modified_base (465)..(465): a, c, t, g, unknown or other
  misc_feature (465)..(465): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcgggggagcgtggtccaggccggggaagtccctgagactctcctgtgcagtcgtccgcgtcccaccttccgtcgtttgctattcacgtcgggtcccgccaggctccgaggcaagggctggagtgggtggcggtnagtagtgggtggatggaagtatgtactattttgngctagtacgtccggtaggaaacgggtcccgactcgacctagtcctaccgaggacggcacgctaccgaaagtacctacttttancgtagactaagttacgaaaccgtgacgacgtacgaccgtacgacggtctgtctaagttacgcggttaccggtcgggggttaccttagggaacggacggtaacggggtccggggccgttacgcgggactaacggttcgggaacccgg

SEQ ID NO: 334174 - DNA, 545 bp, Homo sapiens
  misc_feature: GZ8MTXP01B5CQ9.25.35.D02.1.454.CMB.2.raw
  modified_base (244)..(244): a, c, t, g, unknown or other
  misc_feature (244)..(244): n is a, c, g, or t
  modified_base (414)..(414): a, c, t, g, unknown or other
  misc_feature (414)..(414): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgattcgttggtncttatgacactgtctcctggcaccagtttacccaggaaacgcccccagagtcatcctttatgatgtcaggaagcggccctcgacggggtccctgactcgcttctctggtaccaatctggccaacgaccggccctccctgacctactctcgtgggctccgaggctggaggntgagctgtattagttattgtcttgttcatagtgcaggtctaacgtactgtttaagtggtttccgggcgcgtagggtacccttaaggttcgacccgttcgtcggcgacgcccgagggtccttccgtcccccg

SEQ ID NO: 334175 - DNA, 621 bp, Homo sapiens
  misc_feature: GZ8MTXP01AXHB1.25.35.D02.1.454.CMB.2.raw
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcggggggagcgtggtccgaggccggggaagtccctgagactctcctgtgcagtcgtccgcgtccaccttcgtcgtttggcattcacgtgggtcccnccagggcctccgaggcaaggggctgggagtgggggtggcggtcagtagtgggtgggatagggaataagtgtactaattttcgngacgtacgtaccgtacggagggaacgggcctactcgacctacgtccacgaggacgcacgtacctaccaaacgtaaccttactttagcgtacgtaactaagttaacggaaacgtgaacgaccgtacggactaccgacggtcttacgtcttacgttacgcggccgggtcgggtacaggaacggacggtcggggtccgggccgtacgggacggacgtcggttccgggaacg

SEQ ID NO: 334176 - DNA, 581 bp, Homo sapiens
  misc_feature: GZ8MTXP01DZ9JI.25.35.D02.1.454.CMB.2.raw
  modified_base (301)..(301): a, c, t, g, unknown or other
  misc_feature (301)..(301): n is a, c, g, or t
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccagccggggaatccctgagactctcctgtgcagtcgccgcgtccacctccgtgtttggcattcacgtggtcccncaggctccgaggcaaggggctgggagtggggtggcggtacatagtgggtgggatgggaaagtactgactaattttagngacacgtctccggaggacgggccactcactatcncaggacgcacgactaccaaataccttactttancgtacgactaagtacgaaacgngacgacgtacgaacgacgtaccgtctgtacttaatacgcgggcggttcggggtactaagggaacgttacggcggggtccggggcctcggtacggcttacggtcgggccgcggg

SEQ ID NO: 334177 - DNA, 607 bp, Homo sapiens
  misc_feature: GZ8MTXP01DD7S2.25.35.D02.1.454.CMB.2.raw
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccagccggggaatccctgagactctcctgtgcagtgtccgcgtccaccttccgtcgttttggcatttcacgtgggtccgccagggctccgaggacaaggggactgggagttggggtggcggtcagtagtgggtggatgggaagtatgactattttaagngcacgtacgtcggtagacgggccactcacntcncagagcagcacaacgtacttactttancgtagtactaagttacgaaaccgtgacgtactacgacgtacgtacggtcttcgtaacttagttacgtcgggccgggtcggggttacttaagggaaacggaaacgggtcgggggtaccggggtcccgttacggtaccgggacgtaacggttcggggaaccgg

SEQ ID NO: 334178 - DNA, 632 bp, Homo sapiens
  misc_feature: GZ8MTXP01BENFE.25.35.D02.1.454.CMB.2.raw
  modified_base (390)..(390): a, c, t, g, unknown or other
  misc_feature (390)..(390): n is a, c, g, or t
  modified_base (436)..(436): a, c, t, g, unknown or other
  misc_feature (436)..(436): n is a, c, g, or t
  modified_base (473)..(473): a, c, t, g, unknown or other
  misc_feature (473)..(473): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggagcgtggtccaggccggggaatccctgagactctcctgtgcagtgtccgcgtccaccttccgtcgttttggctattcacgtcgggtcccgccaggcctccgaggcaaggggctgggagtgggtggcggtcagtagtgggtcgggagtaggaagtaatggaactatttttngacgaggactccgggtaggaaacgggcccgtactccaaccattccnccaaggacggcagcctacaaagtacctacctttttanacgtacgtaactaagtacgaaacgtgacgaccgtacgacgtaccgtacggtcttcgtcttagttacggcggccgggtacggggtacaagggaacgggttaaccgggtcgggggtccgggtaaccggtacggtacggacgtaacggttcggggaacccgg

SEQ ID NO: 334179 - DNA, 568 bp, Homo sapiens
  misc_feature: GZ8MTXP01DKFJF.25.35.D02.1.454.CMB.2.raw
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
  modified_base (506)..(506): a, c, t, g, unknown or other
  misc_feature (506)..(506): n is a, c, g, or t
  modified_base (516)..(516): a, c, t, g, unknown or other
  misc_feature (516)..(516): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcggggggagcgtggtccaggccggggaatccctgagctctcctgtgcagtgccgcgtccaccttccggtcgtttggctattcacgtgggtccnccaggcctccgaggcaagggctgggaggtggggtggcgtnagtagtgggtggatgggaatatgactaattttangcagacctccggtaggaacgggccactcaccatcnccagacgcacgctaccaagtaactacctttancctaggactaagttacgaaaccgtgaacgactcgaacgactacggtctgtctaattcgnggcgcgggtntggaaacgcgttacgggtcgggccgttcgacgggcttaggtcggcgtccggg

SEQ ID NO: 334180 - DNA, 592 bp, Homo sapiens
  misc_feature: GZ8MTXP01CI658.25.35.D02.1.454.CMB.2.raw
  modified_base (312)..(312): a, c, t, g, unknown or other
  misc_feature (312)..(312): n is a, c, g, or t
  modified_base (471)..(471): a, c, t, g, unknown or other
  misc_feature (471)..(471): n is a, c, g, or t
tcagactgtacagtcacgaccggtgctcgatttagcacacgatagttgggtttgggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcgggaggtcggggggagcgtggtccaggccggggaagtccctgagacctctcctgtgcagtcgtccgcgtcccaccttccgtcgtttgctattcacgtggtcccncaggcctcgaggcaagggctgggaggtgggtggcggtcagtagtgggtagggatagggaagtatggtaacttattttaagcggtactagaccgtcgtagggaacgggtcccgactcaccatcctaccgagacgtcagcctacaaagtacctacttttancgtagtactaagtacgaaacgtgacgacgtacgacgtacgcgtctgtaactagttcgtcggcggtacgggtcaggacgacgggtccggggtccggtccgtacgtacggcgtcggcgggccg

SEQ ID NO: 334181 - DNA, 650 bp, Homo sapiens
  misc_feature: GZ8MTXP01A51JM.25.35.D02.1.454.CMB.2.raw
  modified_base (182)..(182): a, c, t, g, unknown or other
  misc_feature (182)..(182): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
tcagactgtacagtcacgaccggtgctcgattagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagnggtgtccagtgtcagatgcaacgtggcggaggtcgggggagcgtggtccaggccgggaatccctgagctctctgtgctagtgtccgctccaccttccgtgtttgctattcacgtgggtccccncgcgcncgagacgaaggcgtggaggtgggtcggcgtatagtggtgggtacggtagtaggaagtactgtaacttagttgtgacgtacgtacgtacggtacggacgggtaccgtacctaccacctacgtacctacgacgacgacgacgaccgtaaccgtaacgtaacttaccttactacgtacgtaacgtaacgtaacgtaaacgtacgtacgtacgtaccgaaccgtaccgtaccgtacgtcgtaacgtacgttacgtcggttcggtacgggtacggttacggacggttacggtaacgggtccgggtccggtacggtacggttacggtaacggttcggtaaccggg

SEQ ID NO: 334182 - DNA, 664 bp, Homo sapiens
  misc_feature: GZ8MTXP01DSBMD.25.35.D02.1.454.CMB.2.raw
  modified_base (310)..(310): a, c, t, g, unknown or other
  misc_feature (310)..(310): n is a, c, g, or t
  modified_base (449)..(449): a, c, t, g, unknown or other
  misc_feature (449)..(449): n is a, c, g, or t
  modified_base (485)..(485): a, c, t, g, unknown or other
  misc_feature (485)..(485): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggagcgtggtccaggccggggaatccctgacgactctctgtgcagtgtcccgcgtcccaccttccgtcgttttggctattcacgtggtccnccaggcctccgacggacaaaggggctgggacggttgggtcggcggtacagtagtggggtagggatacggggaaagttaagtgtacttaattttaagtgaccgaagtaccgtccgtagggaacggggtcccactacaccntctccaaggacggcagcctacaaagacctactttanctagacctaaagttacgaaaaccgtgaacgtactacggacgaccgacggtcttggtaacttaacttacgtcggttacggggtacccggggttcttaaaagggacgttaaaaccgggcgggggttccggggaaccccgtttacggacccgggggataaacggttccgggggaaccccggg

SEQ ID NO: 334183 - DNA, 574 bp, Homo sapiens
  misc_feature: GZ8MTXP01C86Q5.25.35.D02.1.454.CMB.2.raw
  modified_base (313)..(313): a, c, t, g, unknown or other
  misc_feature (313)..(313): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcggggggagcgtggtccaggccggggaatccctgacgactctcctgtgcagtcgtccgcgtcccaccttccgtcgtttggctattcacgtgggtccnccaggctccgaggcaagggatggagtgggtgcggtnagtagnggtggatgggaaatatgctaattttangcagactcggagaacgggccactcacatcncagagcagctacaanactctttanctagactaagtacgaacgtgacgtacgcgaacgactacgtctcgtacttaagtcgcggtacggttcgggtactaaggaaacggaccggttacggggtcccgggacctcggtacggcgttacggtcgggccggtccggg

SEQ ID NO: 334184 - DNA, 627 bp, Homo sapiens
  misc_feature: GZ8MTXP01C1UET.25.35.D02.1.454.CMB.2.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
  modified_base (481)..(481): a, c, t, g, unknown or other
  misc_feature (481)..(481): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcgggggagcgtggtccaggccggggaatccctgagactctcctgtgcagtcgtcccgcgtcccaccttccgtcgtttgcattcacgtgggtcccncgaggcctccgaggcaaggggctggaggtgggnggcggtcagtagngggtggataggaactaancgaactagttttaangacaggactccggtaggaaacgggtcccgactcacctatccgaccgaggacggcaacgccctaaccgaaacgtaacctacctttttaacncggtacgtaactaaagttaacgaaaccgtgaactacgtaccgaccgtacgacggtctgtaactagttcgcggccgggtacggtacaacggaacggacggtcggggtcccgggtaaccgtacggacggcgtaacggttcgggaaccg

SEQ ID NO: 334185 - DNA, 608 bp, Homo sapiens
  misc_feature: GZ8MTXP01EZO9A.25.35.D02.1.454.CMB.2.raw
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
  modified_base (452)..(452): a, c, t, g, unknown or other
  misc_feature (452)..(452): n is a, c, g, or t
  modified_base (483)..(483): a, c, t, g, unknown or other
  misc_feature (483)..(483): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccagccggggaatccctgagactctcctgtgcagtgtccgcgtccacctccgtcgtttggctattcacgtggtccncaggctccaggcaagggctgggagtggggtggcggtcatagtgggtgggatgggaagtactggtctaattttagngacagtaccgtcgtaggacgggccactccactactcacgagcgacacgtacctaccaaacgtaccttactttacnccgtacggtaactaaacgttaacgaaaccgngaaccgtacgtacggaccgtacgacgtctagtactaagtcgttggcggttcggtactaaggaacggacggttacggggtcccgggtccgtaacggtaccgacgttacggtccggaaccggtccgg

SEQ ID NO: 334186 - DNA, 844 bp, Homo sapiens
  misc_feature: GZ8MTXP01EQ471.25.35.D02.1.454.CMB.2.raw
  modified_base (164)..(164): a, c, t, g, unknown or other
  misc_feature (164)..(164): n is a, c, g, or t
  modified_base (180)..(180): a, c, t, g, unknown or other
  misc_feature (180)..(180): n is a, c, g, or t
  modified_base (314)..(314): a, c, t, g, unknown or other
  misc_feature (314)..(314): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttccncgttgctcttttaagnggtgtccagtgtcagatgcaacgtgggcggaggtcggggggagcgtggtccaggccggggaagtccctgacgactcctctgtgcagtcgtccgcgtcccaccgttccgtcgtttggctattcacgtcgggtccnccgaggcctccgagggacgaagggggtactggggacggttgggggtcggtcggtacagttaggtgggggtaggggtaactaggggtaaaacgttaagtcggtaaccttaaaagttttttaagcgggacctaaacgggttacccgttacccgggtaaggggaaaccgggggtcccctaacttacccaacccgtaacttcccgtacccgaaagggtaccggggacccaacggtacccgttaaaccccgaaaagttaaaccccctttaaccgttttttaagtcccttacggggtaaacttaaaacggttttaaccgggaaaaaacccggttgaaaccggttaccttaccgggtaaaaccgtaccggaaccggggttctttacggttaaccttaaaggtttaccggttcgggcccgggttacgggggttaccttaaagggggaaaaccggttaaacgggttaccggggggttcccgggggcccttaacggtaacccggggacgttaccggtccgggggttaacccggtccgggg

SEQ ID NO: 334187 - DNA, 621 bp, Homo sapiens
  misc_feature: GZ8MTXP01D66E4.25.35.D02.1.454.CMB.2.raw
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (403)..(403): a, c, t, g, unknown or other
  misc_feature (403)..(403): n is a, c, g, or t
  modified_base (441)..(441): a, c, t, g, unknown or other
  misc_feature (441)..(441): n is a, c, g, or t
  modified_base (478)..(478): a, c, t, g, unknown or other
  misc_feature (478)..(478): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtctgggttttcctcgttgcttctttaagaggtgtccagtgtcagatgcaacgtggcggaggtcgggggagcgtggtccaggccggggaagtccctgagacctctcctgtgcagtcgtccgcgtcctaccgttccgtcgttttggactattcacgtcgggtcccgaccaggcctcgaggacgaagggcgtgggagtggggnggcggttcagtagngggtaggataggggaatacgtgaattattttaacgngacgtacgtcgtacggagggacgggaccctacaccacntccacgagacgcacaccaactaaactaccttactttnacgtactaactaagtacgaaacgtgaacgacgacgacgtacgtacgtcgttcgtaacttacgttcggtcggttcggtacgggtacaagggaccggttacgggtcggggtccggtcgtacgcggttacgtcggttcgggaaccg

SEQ ID NO: 334188 - DNA, 667 bp, Homo sapiens
  misc_feature: GZ8MTXP01EQCWE.25.35.D02.1.454.CMB.2.raw
  modified_base (184)..(184): a, c, t, g, unknown or other
  misc_feature (184)..(184): n is a, c, g, or t
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
  modified_base (488)..(488): a, c, t, g, unknown or other
  misc_feature (488)..(488): n is a, c, g, or t
  modified_base (544)..(544): a, c, t, g, unknown or other
  misc_feature (544)..(544): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagnggtgtccagtgtcagatgcaacgtggcggaggtcgggggagcgtggtccgaggccggggaatccctgacgactctccgtgtgcgtagtcgtccgcgtccaccttcgtcgtttgctagttcacgtcgggtccnccgaggcctccgaggcgaagggtctgggagtggggtgcgtnagtagtgggtaggataggaagtactgtaacttattttgcgacaacgtaccgtccggtagggaacgggccctactcaacctatccgaccgaaggacggactacgacctaacgaaacgtaaccttacctttanaccgtaggtaactaaacgttaacggaaaacccgttgaaccgttacgaccggaaacnccgtacggtccttagttaacttaacgttccggtggttccgggtacgggttaccttaagggaaacgaccgggtccggggtccggtaacccgttcggacggacgtaacggttaaccgggcccggg

SEQ ID NO: 334189 - DNA, 727 bp, Homo sapiens
  misc_feature: GZ8MTXP01BGBZD.25.35.D02.1.454.CMB.2.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
tcagactgtacagtcacgaccggtgctcgatttagcacacgatagttgggtttggggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtnatcgttgggtncttatgacactgtctccgtggctaccgtagttttacccaacggaaaccgcccccagacgtctattccttatgtatgtcgaaggacgcggcccgtcgacggggtcctgacctcgtcttcgtcgtcggtaaccaaagtcgtacgggaccaaccgtacccggtccctaccccgtacgaccctagttcccgtaccgttcggggtcccttaccggacgggtccgttagggaacgggtacgtagggtacgtaccggggttagttaaacgtttaggtttacgttagttccgtttggtttccaagttaacgtcggacgtaacgggtacttaaaccgttaagttagttttcggggttcggtttccgggaccggttaccgggtaaacggggtaacccgttaaacgggtttccgggttaaccccggttcccggtacggggttaaccctaaccgggaccccgggttaaccggtcccgttccccgggtccccccgg

SEQ ID NO: 334190 - DNA, 758 bp, Homo sapiens
  misc_feature: GZ8MTXP01DPFAN.25.35.D02.1.454.CMB.2.raw
  modified_base (254)..(254): a, c, t, g, unknown or other
  misc_feature (254)..(254): n is a, c, g, or t
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
  modified_base (727)..(727): a, c, t, g, unknown or other
  misc_feature (727)..(727): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttctttttaagaggtgtccagtgtcagatgcaacgtgggcgggaggtcgggggggagcgtggtccgaggccggggaagtcccngacgacctctcctgtcgcagtcgtcccgcgtccctaccgttccgttcgtttggctattccacgttcgggtccnccgaggcctccgaggccgaaaggggtcgtgggaggttggggtggcggttanagttaggtgggtagggagtagggaaagttatgtcttaaatttttagcggactacggtacccgttccggtagggaacggggccctaacctacccgacctattcccgaccgaggaaccggacacgtaccctaacccaaaacggttaaccttaaccgttttactaccgtacggtaaacccgtttaaagtttaaaccggaaaaccggttcgaaaccgtaccgttaccggaaaacccggtacgtaccgttcgttacgttacgttaacgttcggttcggggaccgggttacgggttaaccgtagggaaaaaccgcggggttacgggggtcccggggtaccgtaacggacggtacncgggttaaccgggaacccggtaacccggggg

SEQ ID NO: 334191 - DNA, 722 bp, Homo sapiens
  misc_feature: GZ8MTXP01B0BIX.25.35.D02.1.454.CMB.2.raw
  modified_base (416)..(416): a, c, t, g, unknown or other
  misc_feature (416)..(416): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggtttttccctcgttgcttcttttaagaggtgtccagtgtcagatgcaacgtggcggaggtcggggggagcgtggtccgaggccggggaagtccctggacgactctcctgtgctagtcgtcccgcgtcccaccttccggtcgttttggctactttcaccgtgggtcccgccgagggcctccgaggcgaagggactggggaggtggggtgcggtcagtagtgggtagggatagggaagttaatggtacttaagtttttnggaccgtaacgtaccgtccgggtagggaacggggcccctaacttccaacccgtaattccgacccgaaagggaaccgggctaacgggtaccctaacccgaaaagtaaaccctttaacccgtttttacaccgttacggtaaaccttaaacgtttaaaccgggaaaaaccccggttgaaaccggtactaccccccgggaagtacccgacggtccttaggtaaccttaagttccgtaggccgggtacgggtacttagaaacggacggtaacggggtcgggccgtacgtacggctaaggttcgggaaccgg

SEQ ID NO: 334192 - DNA, 628 bp, Homo sapiens
  misc_feature: GZ8MTXP01CNYJQ.25.35.D02.1.454.CMB.2.raw
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
  modified_base (397)..(397): a, c, t, g, unknown or other
  misc_feature (397)..(397): n is a, c, g, or t
  modified_base (490)..(490): a, c, t, g, unknown or other
  misc_feature (490)..(490): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcgggaggtcgggggagcgtggtccaggccggggaatccctgagactctcctgtgcagtgtcccgcgtcccaccgttccgtcgtttggctagttcncgtcgggtcccgccaggcctccgaggcgaaggggacgtgggaggtggggnggcggtcagtagtggtggatggaagtatgaacttatttaagngacagtacgtcggtaggaacggggcccactcgaaccctcttaccgcccgaaggacggtacacggcctaaccaaacgtaaccttacccttttanccgtatcgtaaattacgaaacccgtgacgacctacggacgactcggcttgtcctaattcgacgcgggtacgggttcaacggaacgacggtaacggggtccgggtaaccgtcggtacggctaacggttcgggaacccgg

SEQ ID NO: 334193 - DNA, 573 bp, Homo sapiens
  misc_feature: GZ8MTXP01EGWGX.25.35.D02.1.454.CMB.2.raw
  modified_base (379)..(379): a, c, t, g, unknown or other
  misc_feature (379)..(379): n is a, c, g, or t
  modified_base (446)..(446): a, c, t, g, unknown or other
  misc_feature (446)..(446): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggagcgtggtccaggccggggaatccctgagactctcctgtgcagtcgtccgcgtccaccttccgtcgttttggctattcacgtcgggtccgccaggcctccgaggcaagggctgggagtgggtgcggtcatagtggtggatggaagtatgactattttgngacagtactcggtaggacggccactcactatcacgagacgacacgacctacaaagtacttactttancgtagtactaattacgaaaccgtgacgtacgtacgacgtacgcggtctgtaactagttcgtcggcggtcgggtcaggacgacggtcgggtccgggtcgtacggacggacgtaacggttcgggaaccg

SEQ ID NO: 334194 - DNA, 582 bp, Homo sapiens
  misc_feature: GZ8MTXP01BFYQX.25.35.D02.1.454.CMB.2.raw
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttgagaggtgtccagtgtcagatgcaactggcggaggtcgggggagcgtggtccaggccggggaatccctgacgactctcctgtgcagtgtcccgcgtccaccttccgtcgtttgctattcacgtggtccncaggctccgaggcagggctgggagtgggngcgtnagtagtggnggatggaaatatgactntttangcagactcgngaacgggccagtcacatcncagngcagctaccaagtactaccttttancgtagactaagtacgaaaccgtgaacgtacgtacgaccgacgtacggtctaacgtcttagtacgcggtaccggtacggggttacttagggaaacggtaacgggtcggggtcccggggaccgttaccggttacggtaacgttaacggtccggg

SEQ ID NO: 334195 - DNA, 548 bp, Homo sapiens
  misc_feature: GZ8MTXP01EEI2N.25.35.D02.1.454.CMB.2.raw
  modified_base (243)..(243): a, c, t, g, unknown or other
  misc_feature (243)..(243): n is a, c, g, or t
tcagactgtacagtcacgaccggtgctcgatttagcacacgatagttgggtttggggggggtctcaggaggcagcactctcgggacgtctccaccatggcctgggctctgctcctcctcagcctcctcactcagggcacaggatcccgggctcagtctgccctgactcagcctcgctcagtgtcccgggtctcctggacagtcagtcaccatctcctgcactggaaccagaagtgatcttggncttatgacactgtctcctggcaccagtttacccaggaaaacgcccccagagtcatcctttatgatgtcaggaagcggcctcgaggggtccctgactcgcttctctggtaccaaatctggcaacacggcctccctgaccatctcgtgggctccgaggctggagatgagctagatttattattgtcttgttcatatgacaggtacaacttactagttttgggtgttcggcgacgaggggtaacccttaaggttcgacccggttccgtgggtccacggaccccgaagggtccgttcccggtccccccg

SEQ ID NO: 334196 - DNA, 618 bp, Homo sapiens
  misc_feature: GZ8MTXP01AMFQH.25.35.D02.1.454.CMB.2.raw
  modified_base (313)..(313): a, c, t, g, unknown or other
  misc_feature (313)..(313): n is a, c, g, or t
  modified_base (394)..(394): a, c, t, g, unknown or other
  misc_feature (394)..(394): n is a, c, g, or t
  modified_base (484)..(484): a, c, t, g, unknown or other
  misc_feature (484)..(484): n is a, c, g, or t
  modified_base (601)..(601): a, c, t, g, unknown or other
  misc_feature (601)..(601): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcgggaggtcggggggaggcgtggtccaggcccggggaatccctgagactctcctgtgcagtcgtccgcgtcccaccttcgtcgtttgctattcacgtgggtcccncaggcctccgaggcgaagggctgggagtggggtggcggtcagtagtgggtagggatgggaaagtatggtacttaattttgnggtcaggtacctccggtaggaacggggtcccactcaaccctatccgtaccgaaggacggcacgacctacccaaagtaaccctacttttanccgtagacctaagttacgaaaaccgtgaacgactacgacgtacacggtctgtaacttattccgtcggaccggcgggttacaggaagaccgtaaggggtccgggccgtagacccgggntaacggttcggaaccgg

SEQ ID NO: 334197 - DNA, 565 bp, Homo sapiens
  misc_feature: GZ8MTXP01B9AHU.25.35.D02.1.454.CMB.2.raw
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (443)..(443): a, c, t, g, unknown or other
  misc_feature (443)..(443): n is a, c, g, or t
  modified_base (526)..(526): a, c, t, g, unknown or other
  misc_feature (526)..(526): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggagtcggggggagcgtggtccaggccggggaatccctgagactctcctgtgcagtcgtccgcgtccaccttcgtcgtttgcattcacgtggtccnccaggctccgaggcaagggctggagtgggngcgtnagtagtggtggatggaagtactgactattttngcagtactcgtggaacgggcccaactcaccatctccgaggacggcagcctaccaaagtaacctacttttancgtgtactaaagttacgaaaaccgtgacgactcgacgacacggctgtctattaccgtgcggtacggggtcttaggaacgacgngggtccggggctacggtacggctaacgttcgggaacccg

SEQ ID NO: 334198 - DNA, 620 bp, Homo sapiens
  misc_feature: GZ8MTXP01CL25I.25.35.D02.1.454.CMB.2.raw
  modified_base (182)..(182): a, c, t, g, unknown or other
  misc_feature (182)..(182): n is a, c, g, or t
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (439)..(439): a, c, t, g, unknown or other
  misc_feature (439)..(439): n is a, c, g, or t
  modified_base (510)..(510): a, c, t, g, unknown or other
  misc_feature (510)..(510): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagnggtgtccagtgtcagatgcaacgtgggcggaggtcggggggagcgtggtccaggccgggaatccctgagactctcctgtgcagtgccgcgtcctacctccgtgtttgctattccactcgggtccnccaggcctccgaggcaaaggggctgggagtggggtggcggtcagtagtggtggatgggaatatgntaatttangcagactcgagaacgggccatcacatctcagagcagcctaccaagtaactaccttttanctaggactaagtaacgaaaccgtgaaccgacgtacgaacgtacgtcggtcttacgtaccttaagttccggnggaccgggttcgggtaacgtaacgggaaacggttaccgggttacgggggtcccggggtaccgttaacgggtaccgggacgttacgggtaaccgggcccgggtaacccggg

SEQ ID NO: 334199 - DNA, 561 bp, Homo sapiens
  misc_feature: GZ8MTXP01E428W.25.35.D02.1.454.CMB.2.raw
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (378)..(378): a, c, t, g, unknown or other
  misc_feature (378)..(378): n is a, c, g, or t
  modified_base (414)..(414): a, c, t, g, unknown or other
  misc_feature (414)..(414): n is a, c, g, or t
  modified_base (449)..(449): a, c, t, g, unknown or other
  misc_feature (449)..(449): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtccaccttccgtcgtttggcattcactgggtccnccaggctcaggcaaggggactggagtgggnggcgtcagtatgggtgggatggaaagtaatggactaatttttaagngacacgtacgtcggagggaacggccactcaacctancacgagacgcacgcacaacgtaactacttatcganactaagtaacgaaaccgtgaacgacgtacgacgacacgctgtaactattcgcgcgggtcgggtcgaggaacgaacggcgggtcgggtccgtcgacggacgaagttcggaacg

SEQ ID NO: 334200 - DNA, 727 bp, Homo sapiens
  misc_feature: GZ8MTXP01CO7UK.25.35.D02.1.454.CMB.2.raw
  modified_base (184)..(184): a, c, t, g, unknown or other
  misc_feature (184)..(184): n is a, c, g, or t
  modified_base (266)..(266): a, c, t, g, unknown or other
  misc_feature (266)..(266): n is a, c, g, or t
  modified_base (314)..(314): a, c, t, g, unknown or other
  misc_feature (314)..(314): n is a, c, g, or t
  modified_base (401)..(401): a, c, t, g, unknown or other
  misc_feature (401)..(401): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagnggtgtccagtgtcagatgcaacgtggcggaggtcgggggagcgtggtccgaggccggggaatccctgagactctcctgtgcngtcgtccgcgtccaccttcgtcgtttggctattcgacgtcgggtcccnccgtaggcctccgaggcgaaagggctggaggtgggcggcgtcagtagtgggtaggataggaacgtaatcggaacttaatttttaagngtacgtaaaggtaccccgttccgggagggaaacgggcccgtaacttacccaacccgtaatcccgtacccgaagggaacggtaccaacggaccctaaccgaaacgtaaacccttaaccttttttaactaccggttaacgtaaaccttaaacgttaaacggaaaaccgtgaacgtaccgtaaccggaaccgtaaccggtacgtacgttacgttaacgttaacgttaccggtcggttaccgggtacgggtacgttaacggaaacggttacccgggtaacggggtcccgggtaaccgtacggtaccgggacgtaacggttcgggtcccgg

SEQ ID NO: 334201 - DNA, 694 bp, Homo sapiens
  misc_feature: GZ8MTXP01BKZDE.25.35.D02.1.454.CMB.2.raw
  modified_base (312)..(312): a, c, t, g, unknown or other
  misc_feature (312)..(312): n is a, c, g, or t
  modified_base (534)..(534): a, c, t, g, unknown or other
  misc_feature (534)..(534): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttctttttaagaggtgtccagtgtcagatgcaactggcggaggtcgggggagcgtggtccaggccggggaatccctgagacctctcctgtgcagtcgtccgcgtcccaccttcgtcgtttggctattcacgtcgggtcccnccgaggcctccgagggccgaaggggctggggaggtggggtcggcggtcagtagtgggtagggagtagggaaagttaatgtaacttatttttaagcgtcgtaaggtacccgttccgggtagggtaaacggggccccgtaacgttcccaaccctaacgtcccgtaccggaaggtacgggacctaacggtcctaacccgaaacgtaaccttaaccctttttaacncgttacggtactaaagtttacgaaaaccgttgaacgtacctacgactaccgacggtcctgtaacctagttaccgtggcggtcggggtcttacggaaggttaccgggtcggggtaccgggggccctaacgggtcgggacgtaacggttcgggaaccccggg

SEQ ID NO: 334202 - DNA, 558 bp, Homo sapiens
  misc_feature: GZ8MTXP01BAOU5.25.35.D02.1.454.CMB.2.raw
  modified_base (379)..(379): a, c, t, g, unknown or other
  misc_feature (379)..(379): n is a, c, g, or t
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcgggggagcgtggtccaggccggggaagtccctgagactctcctgtgcagtcgtccgcgtccaccttccgtcgttttggctattcacgtcgggtccgccaggcctccgaggcaagggctggagtgggtggcggtcagtagtggtggatggaagtatgactatttngcagactcgtaggaacgggccactcaccatctaccgagacggcacgccccaagactacctttatctgactaagttacgaaacgtgagacgtcgaacgacncggctcgtctaattacgnggcgcgggtctagaacgacgcgggtaaccgggcgtccgtacggcacgtcggaacggccggg

SEQ ID NO: 334203 - DNA, 715 bp, Homo sapiens
  misc_feature: GZ8MTXP01AYL1S.25.35.D02.1.454.CMB.2.raw
  modified_base (269)..(269): a, c, t, g, unknown or other
  misc_feature (269)..(269): n is a, c, g, or t
  modified_base (397)..(397): a, c, t, g, unknown or other
  misc_feature (397)..(397): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcgggaggtcggggggaggcgtggtccgaggccggggaatccctgagactctcctgtgcngtgtccgcgtccaccgttccgtcgtttgctattcacgtggtcccgcagggcctcgaggcgaagggctgggaggtgggggtggcggttcagtgtggggtaggatgggaaagtatggtaactaattttgngtacgaggtacctccgggtaggaaaccgggggccctaccttcaaaccctacgtccgttacccgaaggaacgggccaacggtacccgtaaccccaaaacggtaaaccctttaccgttttttaacctaccggttacggaaccttaaaacggtttaccggaaaaaaccgttcggaaacgtaccgttaaccggaaccgtaaccgaccgggtcttacggttaacttaacgttacccgtggccgggtacgggggttcttaaggaacggttaacgggtcgggtcccggggtccgtacggtacggcgtaagttccgggaacccggg

SEQ ID NO: 334204 - DNA, 586 bp, Homo sapiens
  misc_feature: GZ8MTXP01BLP7G.25.35.D02.1.454.CMB.2.raw
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
  modified_base (449)..(449): a, c, t, g, unknown or other
  misc_feature (449)..(449): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcggggggagcgtggtccgaggccggggaatccctgacgctctcctgtgcagtcgtccgctccaccttcgtcgtttgctattcacgtggtccncaggcctcgaggcgaaggctggagtgggtggcgtnagtagtgggtggataggaagtatgacttatttngacagacctcggaggaacgggcccactcacatcctacgaggacggcagccaaccaaagtaaccttacttttancggtagtaacctaaagttacggaaaaccgtgaacgactacgacgtacgacggtctgtcttagttcgtggcggtcggggtacttaggaacggacggtggggtccgggcgttacgacgggctaacgttcgggaacccgg

SEQ ID NO: 334205 - DNA, 580 bp, Homo sapiens
  misc_feature: GZ8MTXP01DLWEU.25.35.D02.1.454.CMB.2.raw
  modified_base (306)..(306): a, c, t, g, unknown or other
  misc_feature (306)..(306): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccagccggggaatccctgagactctcctgtgcagtgtccgcgtccaccttccgtcgttttggctattcacgtggtcccncaggctccgaggcaagggctggagtggggtgcggtcagtgtggtggatggaagtatgactattttngacagtactccgtagaacgggcccactcaccatctccgagagcagctcaagactactttnctgactaattacgaaaaccgtgacgtactcgacgacgacggcttggtaacctaagttaccgtggaccggtcgggggtccttaaggaaacggaaccggtaaggggttcccgggggccttcggaacgggcctaagttcggggaacccggg

SEQ ID NO: 334206 - DNA, 578 bp, Homo sapiens
  misc_feature: GZ8MTXP01DDKX5.25.35.D02.1.454.CMB.2.raw
  modified_base (337)..(337): a, c, t, g, unknown or other
  misc_feature (337)..(337): n is a, c, g, or t
  modified_base (380)..(380): a, c, t, g, unknown or other
  misc_feature (380)..(380): n is a, c, g, or t
  modified_base (454)..(454): a, c, t, g, unknown or other
  misc_feature (454)..(454): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagtcggggaagtccctgagactctcctgtgcagtgtccgcgtccaccttccgtcgttttggctattcacgtgggtccgccaggctccgaggcaagggactggagtgggnggcggtcagtgtgggtgggatagggagtaagtgactatttttngctagactccgtaggaacggggcccgactcaccgatccgtaccagagcacgctaccaaagaacctacttttacncgtacgactaaattacgaaaacgtgagactacgacgtacgacggtctgtaactattacgtcgcggtacggggtcttacggaagacgtgggtccgggccgtcgtacggctaagttcggaacccgg

SEQ ID NO: 334207 - DNA, 729 bp, Homo sapiens
  misc_feature: GZ8MTXP01A5EK0.25.35.D02.1.454.CMB.2.raw
  modified_base (249)..(249): a, c, t, g, unknown or other
  misc_feature (249)..(249): n is a, c, g, or t
tcagactgtacagtcacgaccggtgctcgatttagcacacgatagttgggtttggggggggtctcaggaggcagcactctcgggacgtctccaccatggcctgggctctgctcctcctcagccctcctcactcagggcacaggatcccgggctcagtctgccctgactcagcctcgctcagtgtcccgggtctccgtggacagtcagtccaccatctcctgcactggaaccagaagtgattcgttggtntcttatgacctactgtcctcctggacctaaccgtacgtttaacccgaaggaaaaccgcccccaagacgtctacttcctttatgatgtacgaggaacgccggcctcggacggtcctgacctcgtcttcgtcgtcgggtaacccaaagtcgtacgaccaaccgtacccggcccttcccgacgtaccctacttccgtccggtcgggcctaccggaggtccgtagggtagagtacgggagtccgttagtaagtttagttaagttcggtcttcgttactagttagttcggaaccgtacggtaacccttaaacgtttaccgtttaagggttttcgggttacgggtttcccggggaacggttaccgggtaaaccggggtaacccgtttaaacgggttcccggttacccggttaacccgggttacggggttaacccgaacccggtacccggttaaacccgggtccccgttccccgggttcccccccgg

SEQ ID NO: 334208 - DNA, 658 bp, Homo sapiens
  misc_feature: GZ8MTXP01ENN60.25.35.D02.1.454.CMB.2.raw
  modified_base (182)..(182): a, c, t, g, unknown or other
  misc_feature (182)..(182): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
  modified_base (476)..(476): a, c, t, g, unknown or other
  misc_feature (476)..(476): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagnggtgtccagtgtcagatgcaactggcggaggtcggggggagcgtggtccaggccggggaatccctgagactctcctgtgcaggtcgtccgcgtccacctttcgtcgttttggctattcacgtcgggtcccgccgaggcctccgaggcaaagggggtctgggagttgggggtcggnggtcagtagtggggtggataggaacgtaatgacttattttngtcctaagcctcggtagggaacgggcccactcaccatccaccagacggcacgcctacaaagtaaccttaccttttacncgtagtaactaacgttacggaaaaccgtgaacgtaccgtaccggaccgtacgtaccggtcttcgtaacttaacgttcggtcgggttccgggtacggggtacgttaacgggaaacggttaccgggtaacgggggtcccgggtaacccgtacgggacggttacgtaacggttccggggaaccgg

SEQ ID NO: 334209 - DNA, 547 bp, Homo sapiens
  misc_feature: GZ8MTXP01ANB4Y.25.35.D02.1.454.CMB.2.raw
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
  modified_base (379)..(379): a, c, t, g, unknown or other
  misc_feature (379)..(379): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
tcagactgtacagtcacgaccggtgctcgatttagcacacgatagttgggtttggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtgatcttggtgcttatgacactgtcncctggcaccagtttacccaggaaacgcccccagagtcatctttangatgtcagaagcggcctcgacggggtccctgacctcgcttctctcgggtaccaaatctgggacaacaccggcctcccgngaccatctcgtcgggctccaggctgaggatgagcngtattagttattgntgttcatatgacaggtcaacgttactagttttggtcgttcggcgttcgacgggtacccttaaggttcgacccggttcctggggttccacggccccgaagggtcccgttcgtccccccgg

SEQ ID NO: 334210 - DNA, 621 bp, Homo sapiens
  misc_feature: GZ8MTXP01CMGD6.25.35.D02.1.454.CMB.2.raw
  modified_base (322)..(322): a, c, t, g, unknown or other
  misc_feature (322)..(322): n is a, c, g, or t
  modified_base (402)..(402): a, c, t, g, unknown or other
  misc_feature (402)..(402): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (471)..(471): a, c, t, g, unknown or other
  misc_feature (471)..(471): n is a, c, g, or t
  modified_base (496)..(496): a, c, t, g, unknown or other
  misc_feature (496)..(496): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcgggaggtcggggggagcggtggtccgaggccggggaagtccctggagacctctcctgtgcagtcgtcccgcgtcccaccttccgtcgtttggctattccacgtgggtcccnccgaggcctccgagggcaagggggtctgggagtggggtggcggtcagtagtgggtcggataggaagtatgaattatttgngacagactcgaggacgggccactcaccntcnccgagacggcagacctacaaacgtaaccttacctttancgtagacctaagttacgaaaccgtnaacgactcgaacgtctacggtcttggtaaccttagttaccgtgggccgggtacggggtacttagggaaacgaccggtaacgggggtccgggtcctacggtacggctcgggttaacgggaacccgg

SEQ ID NO: 334211 - DNA, 610 bp, Homo sapiens
  misc_feature: GZ8MTXP01B51R8.25.35.D02.1.454.CMB.2.raw
  modified_base (392)..(392): a, c, t, g, unknown or other
  misc_feature (392)..(392): n is a, c, g, or t
  modified_base (465)..(465): a, c, t, g, unknown or other
  misc_feature (465)..(465): n is a, c, g, or t
  modified_base (564)..(564): a, c, t, g, unknown or other
  misc_feature (564)..(564): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggagcgtggtccaggccggggaatccctgagactctcctgtgcagtgtccgcgtcccaccttccgtcgttttggctattcacgtgggtcccgccagggcctccgaggccaaggggctgggaggtggggtggcggtcagtagtgggtgggataggaagtaatggactattttgngacagtactccggtaggacggggcccactcaccatcctaccgagacggcagcctaccaagtaacctactttancgtacgactaaagttacgaaaaccgtgaacgactacggacacgacggtctgtctaacgttacgtggcggtcgggggtcttagggaaacggttaaccggnggggttcccggggccgttcggacggctaacggttcgggaacccggg

SEQ ID NO: 334212 - DNA, 601 bp, Homo sapiens
  misc_feature: GZ8MTXP01EE7NU.25.35.D02.1.454.CMB.2.raw
  modified_base (184)..(184): a, c, t, g, unknown or other
  misc_feature (184)..(184): n is a, c, g, or t
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (531)..(531): a, c, t, g, unknown or other
  misc_feature (531)..(531): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttggggttttcctcgttgcttcttttaagnggtgtccagtgtcagatgcaacgtggcggaggtcgggggagcgtggtccaggccggggaatcctgacgactctctgtgcagtcgtccgctccaccttccgtcgtttgctattcacgtgggtcccncgaggctccgaggcaagggctgggagtgggtggcgtnatagnggtggatggaatatgactatttngacagactcggtggaaacgggcccactcgactagtctaccgaagcggcagtcctacaaacgtacttacctttncgtanacctaaatacgaaacgtgaacgacctacgaccgtacacggcttaggtaactttaacgttcgtcgcgggtaccgggttanacggttaacggaccggtaagggggtcccgggaaccgttacggaccggttcgtaacgttcggggaaccccg

SEQ ID NO: 334213 - DNA, 626 bp, Homo sapiens
  misc_feature: GZ8MTXP01BIRAI.25.35.D02.1.454.CMB.2.raw
  modified_base (184)..(184): a, c, t, g, unknown or other
  misc_feature (184)..(184): n is a, c, g, or t
  modified_base (268)..(268): a, c, t, g, unknown or other
  misc_feature (268)..(268): n is a, c, g, or t
  modified_base (358)..(358): a, c, t, g, unknown or other
  misc_feature (358)..(358): n is a, c, g, or t
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (461)..(461): a, c, t, g, unknown or other
  misc_feature (461)..(461): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatgggagtttgggctgcgcttgggttttcctcgttgcttcttttaagnggtgtccagtgtcagatgcaacgtgggcggaggtcggggggagcgtggtccgaggccggggaatccctgagcctctcctgtgcngtgtccgctccaccttcgtcgtttgctattcacgtcgggtccgccaggcctcgaggcgaaagggctgggagtggggtggcggtcagtagngggtgggatggaagtaactgtctatttngctagactcggtggaaacgggcccactcactntcnccgaggacgcacgccacaaacgtaacctacgtttttaacncgtacgtaactaagtaacgaaacgtcgacgaccgtacgacgtaccgtacgtcttcgtaacttagttacgtcgggccgggtaccgggtacttaggaaacgggttacgggtccgggggtaccggggtccgtacgggtacggacgtaacgggttccggggtaacccgg

SEQ ID NO: 334214 - DNA, 521 bp, Homo sapiens
  misc_feature: GZ8MTXP01AGA3G.25.35.D02.1.454.CMB.2.raw
  modified_base (245)..(245): a, c, t, g, unknown or other
  misc_feature (245)..(245): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (510)..(510): a, c, t, g, unknown or other
  misc_feature (510)..(510): n is a, c, g, or t
tcagactgtacagtcacgaccggtgctcgatttagcacacgatagttgggtttggggggggtctcaggaggcagcactctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagcccgtgacattgggtncttaataactatgtctcctggtcccaacaacaccagcaaggcccccaaatcatcatttangatgtcagtcatcggcctntggatttcnggtcncttctntgctcaaagtctggcaacgtcggcctcctgaccatcgtcggggctccgaggctggacggacgaggtctacttattattgctatttcatacagagacacanagtctggtgtcggnggaaggacaagttcgaccgtcncggttcncgcccaaggctcgcccctggccncgttcgtcccg

SEQ ID NO: 334215 - DNA, 643 bp, Homo sapiens
  misc_feature: GZ8MTXP01EPK48.25.35.D02.1.454.CMB.2.raw
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (490)..(490): a, c, t, g, unknown or other
  misc_feature (490)..(490): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcggggggagcgtggtccgaggccgggaatccctgacgctctctgtgcagtcgtccgcgtcctacctccgtcgtttggctattcacgtcgggcccncaggcctccgaggccaagggctgggaggtgggtggcgtnagtagtgggtcggataggaaagttagtgtacttaaatttttagcggactaaggtacccttcgggtaggaaacgggggccctactaccgacctatccgccgaaggacggcacgtcctaaccgaaagtacccttacttttanccgtaggaactaaagttacgaaaaccgtgaacgactaccggacgaccgtacggtcttcgtctaacgttcgcggtcgggttacgggtctaagggaacggacggttacggggtccgggtccgtaacgtacggcgacgtccgggaaccgtccgggg

SEQ ID NO: 334216 - DNA, 653 bp, Homo sapiens
  misc_feature: GZ8MTXP01BGKH9.25.35.D02.1.454.CMB.2.raw
  modified_base (180)..(180): a, c, t, g, unknown or other
  misc_feature (180)..(180): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagnggtgtccagtgtcagatgcaacgtgggcggaggtcggggggagcgtggtccaggccggggaagtccctgagactctcctgtgcagtcgtccgcgtccncctccgtcgtttgctattcacgtgggtccncgaggctccagggcaagggctgggagtgggtgcggtnagtagtgggtggatggaagtaatgctaattttangcagtactccggtagaacggggcctactccactatcaccgagacggctagcctaaccgaaanaaccttacctttancctagggtactaaagttacgaaaaccggtgaaacgtcgtacgaaccgaccgcgggtacttaggttctaacgtttccgcggggccggttccgggggttacctaaggggaaaccggacccgggttaggggggttccccggggacccgtttaaccggtaacggggcccttaaggttcccggggaaccgggtaaccccgggg

SEQ ID NO: 334217 - DNA, 681 bp, Homo sapiens
  misc_feature: GZ8MTXP01BOSSK.25.35.D02.1.454.CMB.2.raw
  modified_base (184)..(184): a, c, t, g, unknown or other
  misc_feature (184)..(184): n is a, c, g, or t
  modified_base (332)..(332): a, c, t, g, unknown or other
  misc_feature (332)..(332): n is a, c, g, or t
  modified_base (424)..(424): a, c, t, g, unknown or other
  misc_feature (424)..(424): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagnggtgtccagtgtcagatgcaacgtggcggaggtcgggggagcgtggtccgaggccggggaatccctgacgtactctcctgtgcagtcgtcccgcgtcccacccgtttccggttcgttttggcctacgtttccgaccgttcgggtcccnccgaggcctaccgagggcgaaaggggcgtgggacggtggggtggccgttgagtagtggggtaggagtaggaagtactggaacttagttttgngtacgagtaccgtccggtaggaaccggggtcccacctcgaaccatccgtacgaggacggtccacgacctaacccgaaagtaacccttactttaatcgtacgtaactaaacgttacgaaaaccgtgaactaccgtacggaccgtacgacgtctacgtctaacgttcgtcggccggtcggggttcacgggttaaacgaaccgggtcggggtacccgggtcccgttcggaaccggcgtaacgggttccgggaaccccggg

SEQ ID NO: 334218 - DNA, 657 bp, Homo sapiens
  misc_feature: GZ8MTXP01B8V92.25.35.D02.1.454.CMB.2.raw
  modified_base (308)..(308): a, c, t, g, unknown or other
  misc_feature (308)..(308): n is a, c, g, or t
  modified_base (499)..(499): a, c, t, g, unknown or other
  misc_feature (499)..(499): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccgaggccggggaatccctgagactctcctgtgcagtcgtccgcgtccaccttcgtcgtttgctattcacgtggtccnccaggcctcgaggcgaagggcgtggagtgggtggcgtcagtagtgggtaggataggaaagtaatggtacttaagtttttgcgtacgtaacggtaccgtccgggtagggaaacggggccctactacccaacctactccgtaccgaaggacggaccacgtaccctaaccaaacgtaaccctttaccttttaancgtacgtaactaaacgttaacgaaaaccgtgaacgtaccgtaccggaactaccgtacgtctgtaaccttaagttcgcggcggtacgggtcttaacgggaaacgaccggtaagggggtccccgggccgttacggacggcgtaacggttcgggaacccgg

SEQ ID NO: 334219 - DNA, 647 bp, Homo sapiens
  misc_feature: GZ8MTXP01ALNIH.25.35.D02.1.454.CMB.2.raw
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
  modified_base (477)..(477): a, c, t, g, unknown or other
  misc_feature (477)..(477): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccaggccggggaatccctgagctctcctgtgcagtcgtccgcgtccaccttccgtgtttgctattcacgtcgggtcccnccaggcctaccgaggccaaaggggctggaggtggggtcggcggttcagtagtgggtggatggaagtatgaactattttngctagacctccggtagaacgggtccctacgcacactccgtaccgagacggacacgtacctacccgaaacgtaaccttacctttttaacnccgttacgtaaccgtaaacgttaacggaaaaacccgttggaaccgtaccgtaccgaacggaccgtacggtcttgtaaccgttattacgtcggcgggtacggggtacttacggaacgacgggaacggggtcgggccgttacggtacgggcgtaacggttcgggaacccggg

SEQ ID NO: 334220 - DNA, 620 bp, Homo sapiens
  misc_feature: GZ8MTXP01EJDUZ.25.35.D02.1.454.CMB.2.raw
  modified_base (311)..(311): a, c, t, g, unknown or other
  misc_feature (311)..(311): n is a, c, g, or t
  modified_base (496)..(496): a, c, t, g, unknown or other
  misc_feature (496)..(496): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcgggggagcgtggtccaggccggggaatcctgagctctcctgtgcagtcgtccgcgtcccaccgttccgtcgtttgactatccacgtcggtccnccgaggctccgaggcgaaagggcgtgggacggtgggggtggcggttacagttaggtgggtaggggactagggaaagtactgaacttaattttgcgcgtaagtaccgtccggtagggaaacggggcccctaactcgaaccatccgaccaggacggcacgacctaaccaagtaaccttacttttacncgtacgaacttaaagtacgaaacgtcgacacgtacgacgtacgcgtctgtaactacgttcggcggttcgggtacggtacaacggacgacggtcggggccggtcctacggacgctaaggcggccg

SEQ ID NO: 334221 - DNA, 630 bp, Homo sapiens
  misc_feature: GZ8MTXP01BYECG.25.35.D02.1.454.CMB.2.raw
  modified_base (295)..(295): a, c, t, g, unknown or other
  misc_feature (295)..(295): n is a, c, g, or t
  modified_base (442)..(442): a, c, t, g, unknown or other
  misc_feature (442)..(442): n is a, c, g, or t
  modified_base (497)..(497): a, c, t, g, unknown or other
  misc_feature (497)..(497): n is a, c, g, or t
tcagactgtacagtcacgaccggtgctcgatttagcacacgatagttgggtttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgattcgttggtgtcttatcgactactgtctcctggctacctacgtttaacccaaggaaaacncccccaagacgtcacttcctttatgatgtacgaggaacgccggccctcgacgggtccctgacctcgtcttcgtcgtcggtaacccaatcgtggaccaaccgacccggtccctcccgtacgaccctatccgtcgtcggggcctaccgnggccgtggaaggcgtggacggtctagtatttagttagtttcgtcgttacgtttanagtgtacgacgtacgtactaacgttacgttggtttcggtcgttacgggtcgacggtacgggtaacgttacggttccggttaccggttcggtacgggtccgtaccgaccggttaccgtcccgttcccgtccccg

SEQ ID NO: 334222 - DNA, 605 bp, Homo sapiens
  misc_feature: GZ8MTXP01B8Y8K.25.35.D02.1.454.CMB.2.raw
  modified_base (385)..(385): a, c, t, g, unknown or other
  misc_feature (385)..(385): n is a, c, g, or t
  modified_base (452)..(452): a, c, t, g, unknown or other
  misc_feature (452)..(452): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccaggccggggaatccctgagactctcctgtgcagtcgtccgctccaccttcgtcgtttggctattcacgtcggtccgccaggcctccgaggcgaagggctggagtgggtggcggtcagtagtgggtggataggaagtaatgacttattttaagngtacagtactccggtaggaacgggcctactcaccatccacagagcagcctacgaacaactactttancgtacgtactaagttacgaaaaccgtgaacgtactaccgacgaaccgtacggtctggtctaagttacgcggcggtaccggggtattacgggaacgacggtcggggtccgggggtaaccttcgggacggacgtaacgggttcgggaaccccggg

SEQ ID NO: 334223 - DNA, 597 bp, Homo sapiens
  misc_feature: GZ8MTXP01AQKUY.25.35.D02.1.454.CMB.2.raw
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
  modified_base (465)..(465): a, c, t, g, unknown or other
  misc_feature (465)..(465): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggagtcgggggagcgtggtccaggccgggaatccctgagactctcctgtgcagtgtccgcgtccaccttcgtcgtttgcattcactgggtccnccaggctcgaggcaagggctggagtgggtggcggttanagtagtgggtaggagtaggaagtatgtaacttatttgngacgaggtaccgtacgggaggacgggccactccacctactccgtaccgaggacggcacgcctaacgtaaacgtaaccttacttttancgtacgtaactaagtacggaaaccgtgaacgaccgtacgacgtacgacggtctgtaacttagttcggcggcgggtacgggtacagggaacgacggtcgggtccgggcgtcgacggcgtaacggttcgggccg

SEQ ID NO: 334224 - DNA, 648 bp, Homo sapiens
  misc_feature: GZ8MTXP01B33GE.25.35.D02.1.454.CMB.2.raw
  modified_base (327)..(327): a, c, t, g, unknown or other
  misc_feature (327)..(327): n is a, c, g, or t
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcgggaggtcggggggaggcgtggtccgaggccggggaagtccctgagactctctgtgcaggtcgtcccgcgtccctaccgttccggttcgttttggctattccgacgtcggggtcccnccgaggcctccgagggccaaaggggctgggaggtggggtggcggtnagtgtggtgggatgggaatatgtntaatttancgnagtacgtccggtaggacgggcccactcacgatctcgagacgtcacgctaccgaaagtaaccttacctttatccaggtacctaaagtttaccgaaaaccgttgaacgtaccgtacgaaccgtcgacggtctcggttactaacgttacgcggtacgggcggggttactacgaaacgggttacggacgggggtaacgggggtcccttcggtcccggagttcggtccggggaaccggtccgggg

SEQ ID NO: 334225 - DNA, 660 bp, Homo sapiens
  misc_feature: GZ8MTXP01ADHUX.25.35.D02.1.454.CMB.2.raw
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (474)..(474): a, c, t, g, unknown or other
  misc_feature (474)..(474): n is a, c, g, or t
  modified_base (500)..(500): a, c, t, g, unknown or other
  misc_feature (500)..(500): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggtttttcctcgttgcttcttttaagaggtgtccagtgtcagatgcaacgtgggcgggaggtcgggggagcgtggtccgaggccggggaatccctgacgactctcgtgtgcngtcgtccgctccctaccttccgtgtttgctattccgacgtcgggtcccnccaggcctccgaggcgaagggctgggaggtgggnggcgtnagttaggtgggtggatggaagtactggtacttattttgcgcgagtacctcggaggaacggtcccactcactactcgaccgagacgacacgacctaaccaagtaaccttactttacncgtagaactaaatacgaaaaccggtnaacgtaccgtaccggaacgtaccgtaccggtctttacggtaaccttaacgtttccggccgggttaccggggttacgggtaccgttaaggaaacggttacccgggtaacggggtacccgggtcctacgggtacccggagtaacggttcggggaaccccggg

SEQ ID NO: 334226 - DNA, 606 bp, Homo sapiens
  misc_feature: GZ8MTXP01BXX32.25.35.D02.1.454.CMB.2.raw
  modified_base (352)..(352): a, c, t, g, unknown or other
  misc_feature (352)..(352): n is a, c, g, or t
  modified_base (387)..(387): a, c, t, g, unknown or other
  misc_feature (387)..(387): n is a, c, g, or t
  modified_base (459)..(459): a, c, t, g, unknown or other
  misc_feature (459)..(459): n is a, c, g, or t
  modified_base (562)..(562): a, c, t, g, unknown or other
  misc_feature (562)..(562): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcgggaggtcggggggaggcgtggtccgaggccggggaatccctgagtactctctgtgcagtcgtccgcgtcccaccttcgtcgtttgctattccacgtggtcccgccaggcctccgaggcaagggctgggagtgggtgcggtnagtagtgggtggataggaagtatgtaacttatttngcaggtacctcggtaggaacggcccgactcaccatcgtccaggacggcagcctacaacgtaacttactttanacgtgtactaagtacggaaaaccgtgaacgactaccggacgtaccgtacgtctgtaactagttacgtcggaccgggtcggggtattacgggaacgttaacggnggggtccgggccgtacggtaccggcgtaacggttcggaacccgg

SEQ ID NO: 334227 - DNA, 704 bp, Homo sapiens
  misc_feature: GZ8MTXP01BDZVK.25.35.D02.1.454.CMB.2.raw
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggagcgtggtccaggccggggaagtccctgacgactctccgtgtgcagtcgtccgcgtccaccttccgtcgttttggctattcacgtcgggtcccgccaggcctccgaggccaagggctgggagttgggggtggcgtacagtaggtgggtagggataggggaaagtaatggaacttattttgcgtacaaggtaccttccgggtagggaaacggggtccccgtaacttccgaaccctatcccgtcccgaagggacggccaaggacccttacccgaaaagtaaacccttaaccttttttacgaccttaggtaacctaaagtttaacggaaaacccgttgaacgtaacccgttacggaacgaaccgtacggtccgttggtaaccttaagtttaccgtcgggcggtaccgggggttacttacgggaaacgaaccgggtcgggggttccggggcccgtacggtcgggacctaaggttcggggaacccgg

SEQ ID NO: 334228 - DNA, 638 bp, Homo sapiens
  misc_feature: GZ8MTXP01CZBQS.25.35.D02.1.454.CMB.2.raw
  modified_base (308)..(308): a, c, t, g, unknown or other
  misc_feature (308)..(308): n is a, c, g, or t
  modified_base (391)..(391): a, c, t, g, unknown or other
  misc_feature (391)..(391): n is a, c, g, or t
  modified_base (469)..(469): a, c, t, g, unknown or other
  misc_feature (469)..(469): n is a, c, g, or t
tcagactgtacagtcacgaccggtgctcgatttagcacacgatagttgggtttgggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcgggaggtcggggggaggcgtggtccaggccggggaagtccctgagactctcctgtgcagtgtccgcgtccaccttcgtcgtttgcattcactggtccncaggctccgaggcaagggactgggagtgggggtggcggtcaagtgtggggtggactaggaagtaacgtgacttagtttttaanggcctaaggacctaccgggtagaaacgggcccgactcaaccatctaccgagagcagcctaccaaagaactacctttanctgactaattacgaaaaccgtgaacgtactaccggactaccgaacgtcgtcgtaacttaacgttaccgtggccgggtacgggggtcttaacgggttaaacgaacgggtaaccggggtccgggggtcccgtacggtaaccgggactaacggggttaacgggtaacccggg

SEQ ID NO: 334229 - DNA, 656 bp, Homo sapiens
  misc_feature: GZ8MTXP01AD4J1.25.35.D02.1.454.CMB.2.raw
  modified_base (354)..(354): a, c, t, g, unknown or other
  misc_feature (354)..(354): n is a, c, g, or t
  modified_base (393)..(393): a, c, t, g, unknown or other
  misc_feature (393)..(393): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcgggaggtcggggggagcgtggtccaggcccggggaagtccctgacgactctcctgtgcagtcgtccgcgtccaccttccgtcgtttggctattcacgtgggtcccgcaggctccgaggcgaagggctgggagtggggtggccggtnagtagtgggtggatgggaagtagtgaactagtttttcgngtacgtaggtacgtcgggtacggaaccgggtccctacctaccgaaccctacgtccgtaccgaggacggacctaacgtaccctaaccgaaacgtaaccttaaccttttacaccggtacgtaacgtaaacgttaacggaaaccgtagacgtaccgtaccgacgtaccgacgtactgttaacctagttccgtcggcgggtcgggtacgttacggaacggacggtcggggtccggccgtcggtacggcgtaacggttcgggtaaccg

SEQ ID NO: 334230 - DNA, 688 bp, Homo sapiens
  misc_feature: GZ8MTXP01AYCSG.25.35.D02.1.454.CMB.2.raw
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
  modified_base (429)..(429): a, c, t, g, unknown or other
  misc_feature (429)..(429): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcgggaggtcggggggaggcggtggtccgaggccggggaagtccctgagtactctcctgtgcagtcgtccgcgtcccaccttcgtcgtttggctattccacgtggtcccgcaggcctccgaggcaagggctgggagtggggtggcgtanagtagtggtggatggaagtatgaacttatttgngctaggtacctcggtaggacgggtcccactccaacccgtntccgtaccgaggacggacctacgccttaaccgaaacgtaaacttacccttttagccgtagactaaacgttacgaaaacccgtgaacgtactacggaccgtaaccgtacggtcttaggtaaccttaacgttacggtcggttcccgggtcgggggttaacaacggggttaacggttaacccgggtaacggggggtttccccggggaaccggtttcccggtaaacggggcccctaaggggttccccgggggtaaccccgggg

SEQ ID NO: 334231 - DNA, 642 bp, Homo sapiens
  misc_feature: GZ8MTXP01AOEJ9.25.35.D02.1.454.CMB.2.raw
  modified_base (405)..(405): a, c, t, g, unknown or other
  misc_feature (405)..(405): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggagcgtggtccaggccggggaatccctgagacctctcctgtgcagtcgtccgcgtccaccttccggtcgttttggctattccacgtgggtcccgccaggcctccgagggcaaagggaccgtgggacgtggggtcggcggttacattagtgggtgggattcgggaagtaatgacttattttaacgngacacgtacgtacggtaggacgggcctacctacacctacgtccgaccgaggacgactacgaccctaaccgtaaacgtaacccttaaccttttacaccggtacgtaactaaacgttaaccgaaaccgtgaacgaccgtacggaaccgtacgcgtacttgtaacttagttcgtcggcgggtacgggtacaggacgacggtcggggtccggtcgtacgacggacgtaaggttcggaaccg

SEQ ID NO: 334232 - DNA, 648 bp, Homo sapiens
  misc_feature: GZ8MTXP01AS1CZ.25.35.D02.1.454.CMB.2.raw
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (397)..(397): a, c, t, g, unknown or other
  misc_feature (397)..(397): n is a, c, g, or t
  modified_base (493)..(493): a, c, t, g, unknown or other
  misc_feature (493)..(493): n is a, c, g, or t
  modified_base (566)..(566): a, c, t, g, unknown or other
  misc_feature (566)..(566): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcggggggagcgtggtccgaggccggggaagtccctgagcctctccgtgtgcagtcgtccgcgtcccaccttccgtcgtttgctattcncgtcgggtcccncgacggctccgaggcgaagggcgtggaggtggggnggcgtnagtagtggggtggagtaggaaagtagtgaacttattttaangacgtagtaccgtccgggtagggaaacgggccctactccgaacctagtccgtaccgaggacggtcacgtactaccgaaacgtaaccttacttttancgttacgtaactaaacgtttacggaaaaccgtgaacgtacgtacggacgtacgacggtcttgtctagttacgnggaccgggtcgggtacttaggaacggttaacggcgggggtccgggccgttacgaccgggactaacgggttccggggaacccg

SEQ ID NO: 334233 - DNA, 629 bp, Homo sapiens
  misc_feature: GZ8MTXP01BTRF1.25.35.D02.1.454.CMB.2.raw
  modified_base (184)..(184): a, c, t, g, unknown or other
  misc_feature (184)..(184): n is a, c, g, or t
  modified_base (287)..(287): a, c, t, g, unknown or other
  misc_feature (287)..(287): n is a, c, g, or t
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
  modified_base (394)..(394): a, c, t, g, unknown or other
  misc_feature (394)..(394): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagnggtgtccagtgtcagatgcaacgtggcgggaggtcggggggagcgtggtccgaggcccggggaagtccctgacgtactctcctgtgcagtcgtccgcgtcccnccttcgtcgtttgctattcacgtcggtccncgaggcctcgaggcgaagggtctgggacggtgggtcggcggtnagtaggtgggtggatagggaatatgattagtttngcagtcctcggtaggaacggcccactcacctagtcctaccgaggtaccggctacgacctaaccgaacgtaacctttacctttacgtactcgtaactaaagtttaccgaaaaccgttgacgttaccgacgacgaactccggtctgtaaccttagttacgtcgggcggtcgggtacagggaacggttacggtcgggggtaccgggccgttcggacggcgtaacgttcggggaacccg

SEQ ID NO: 334234 - DNA, 768 bp, Homo sapiens
  misc_feature: GZ8MTXP01DF86Y.25.35.D02.1.454.CMB.2.raw
  modified_base (365)..(365): a, c, t, g, unknown or other
  misc_feature (365)..(365): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactgggcggaggtcggggggagcgtggtccaggccggggaagtccctgagactctcctgtgcagtcgtccgcgtccaccttccgtcgtttgctattccacgtcgggtcccgccgaggcctacccgaggaccgaaggggacgtgggaggtggggtggccggtanagtagtggggtagggatagggaaagtaatcggtaacttatttttgcgtactaacggtaccgttccgggtaggggaaccggggccccgtacttaccaaccctaacgttcccgtacccgaaggacgggaccaaaccgggtaccttaaacccaaacggttaaaacccttacccgtttttaaactaccggttacgtaaacgttaaaacgtttaaaccgggaaaaaaccgttcggaaacgtaaccgttacccggaaaccggtaaccgaaacccgggttccttaggttaaccttaacgttaaccggtcgggacgggttcggggtaaccttagggaaaccgttaaaccgggtcgggggtacccgggtcccgttacgggacggttaccgtaacggttcggggaaccccggg

SEQ ID NO: 334235 - DNA, 604 bp, Homo sapiens
  misc_feature: GZ8MTXP01C6JAM.25.35.D02.1.454.CMB.2.raw
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (448)..(448): a, c, t, g, unknown or other
  misc_feature (448)..(448): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcgggaggtcggggggaggcgtgggtccaggccggggaagtccctgagactctcctgtgcagtcgtccgcgtccaccttccgtcgtttgctattcacgtggtccgccaggctccgaggcaagggctgggagtggggngcggtcagtagtgggtggataggaataatggtaactattttngcagactcgtagaacgggccactcaccatctacagagcagctacaaagacctacctttancgtagactaaattacgaaaaccgtgaacgtactaccgaacgacgtacggcttgtcttaagttaccgtcggccgggtcggggtacttaacggaaacggaacgtcgggggtaccggggtcccgttacggacgggttactaacggttcggggaacccgg

SEQ ID NO: 334236 - DNA, 571 bp, Homo sapiens
  misc_feature: GZ8MTXP01EZ6SI.25.35.D02.1.454.CMB.2.raw
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (368)..(368): a, c, t, g, unknown or other
  misc_feature (368)..(368): n is a, c, g, or t
  modified_base (450)..(450): a, c, t, g, unknown or other
  misc_feature (450)..(450): n is a, c, g, or t
  modified_base (526)..(526): a, c, t, g, unknown or other
  misc_feature (526)..(526): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcgggggagcgtggtccaggccgggaatccctgagctctcctgtncagtcgccgcgtccaccttcgtcgtttgctattcacgtggtccncaggctcgagcaaggctggagtgggngcgtnagtgtggtggatggaatactgtaactattttngtacagtaccgtcggtaggaacgggcctactacacctactccaccgagacggacacgacctacaagtaacctaccttttaancgtacgtactaacgtacgaaacgtgaacgtacgtacgacgtacgtacgtctatctacgttcgcggcggtacggtanacggacgacggtcgggtccggccgtacgacggctaacggcggccg

SEQ ID NO: 334237 - DNA, 724 bp, Homo sapiens
  misc_feature: GZ8MTXP01CX4G4.25.35.D02.1.454.CMB.2.raw
  modified_base (314)..(314): a, c, t, g, unknown or other
  misc_feature (314)..(314): n is a, c, g, or t
  modified_base (408)..(408): a, c, t, g, unknown or other
  misc_feature (408)..(408): n is a, c, g, or t
  modified_base (643)..(643): a, c, t, g, unknown or other
  misc_feature (643)..(643): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggagtcggggggagcgtggtccaggccgggaagtccctgagctctcctgtgcagtgcccgcgtccaccgttccgtcgttttggctactttcaccgtgggtcccnccaggcctccgaggcaaaggggctgggaggtggggtgcggtcagtagtggggtacgggagtaggaagttaaactggtaacttaagtttttaagngacgtaacgtaaccgttcccggtagggaaacgggggtccctactacccaccctaagtcccgtacccgaagggaccgggacacggtacccttaaccgaaaacgtaaccctttacccgttttttacacgttaggtaaccctaaagtttacggaaaaacccttggaaacgaccgttaccggaacaccgtaccgggtccttggtaaccttcgttaagtccgggaacgggtccggggttnttaaacgggaacggttaaacccggtgggggttacccgggggcccgtttacgaccgggttcaacgggttcggggaaccccgg

SEQ ID NO: 334238 - DNA, 603 bp, Homo sapiens
  misc_feature: GZ8MTXP01AXJPR.25.35.D02.1.454.CMB.2.raw
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (380)..(380): a, c, t, g, unknown or other
  misc_feature (380)..(380): n is a, c, g, or t
  modified_base (463)..(463): a, c, t, g, unknown or other
  misc_feature (463)..(463): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcggaggtcgggggagcgtggtccgaggccgggaatccctgagactctcctgtgcagtcgtcccgcgtccaccttccgtcgtttgctattccacgtgggtcccnccgaggcctcgaggcaagggctgggagtgggtgcggtnagtagnggtggatggaatatgactaattttangacagacgtcgtagaacgggccaactcaccgtatccgtaccgaggacggcaggcccttaaccgaaagtaccttaccgttttancgtacggtactaagtaacgaaaccgtgacgaccgtacgaccgacgtcgtctacgtctaagtcgcggcggcggtacgaacggacggaccggttcggggtcccgggtacctcggacggcgacgggtccggaaccggtccggg

SEQ ID NO: 334239 - DNA, 632 bp, Homo sapiens
  misc_feature: GZ8MTXP01AQQWO.25.35.D02.1.454.CMB.2.raw
  modified_base (184)..(184): a, c, t, g, unknown or other
  misc_feature (184)..(184): n is a, c, g, or t
  modified_base (252)..(252): a, c, t, g, unknown or other
  misc_feature (252)..(252): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
  modified_base (409)..(409): a, c, t, g, unknown or other
  misc_feature (409)..(409): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagnggtgtccagtgtcagatgcaacgtgggcgggaggtcgggggagcgtggtccgaggccggggaatcccngagctctctgtgcagtcgtccgcgtcccaccttcgtcgtttgctattcacgtggccnccaggctcgaggcgaaggctggagtggtggcgtnatgtggtggatggaatatgaactatttngacagtaccgtcgtaggaaacgggcccactcgaacctntccgaccgaaggtacggactacgacctaaccgtaaacgtaacctttacctttttagtacgaaacttaagttaacgaaacccgttgaacgtacgtaccgaacgtactaccggtcttacgtcgtaacttacggcggtacggttcgggtactaaggaaacggttcggttaccggggtccggggtcctaacggtacggacgttacggtcgggaacccgtaaccgggg

SEQ ID NO: 334240 - DNA, 705 bp, Homo sapiens
  misc_feature: GZ8MTXP01BAWWZ.25.35.D02.1.454.CMB.2.raw
  modified_base (184)..(184): a, c, t, g, unknown or other
  misc_feature (184)..(184): n is a, c, g, or t
  modified_base (315)..(315): a, c, t, g, unknown or other
  misc_feature (315)..(315): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggtttttcctcgttgcttcttttaagnggtgtccagtgtcagatgcaacgtggcggaggtcgggggagcgtggtccaggccggggaatccctgagactctcgtgtgcaggtcgtcccgcgtccaccgttccgtcgtttggctattcacgtgggtcccncaggcctccgaggcaagggctgggagtgggtgcggtcagtagtgggtaggatagggaaagttaactggtaacttaattttgcggtactaggtacccttccgggtagggaaaccggggccctaacttccaaccgtattccgtacccgaagggtacggactacggtccttaacccgaaaacgttaacccttaaccgtttttactaccgttaggtaaaccttaaacgtttacggaaaaaacccgttgaaaccgtaccgtaccggacgaaccgtacggtactcggtttaacctagtttacgcgggaccgggtacggggttaccaagggaaacgaccgggtaaggggtcccgggggtccttacggtaccggccgtaacggttcggggaaccccgg

SEQ ID NO: 334241 - DNA, 614 bp, Homo sapiens
  misc_feature: GZ8MTXP01AJ3P0.25.35.D02.1.454.CMB.2.raw
  modified_base (251)..(251): a, c, t, g, unknown or other
  misc_feature (251)..(251): n is a, c, g, or t
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
  modified_base (387)..(387): a, c, t, g, unknown or other
  misc_feature (387)..(387): n is a, c, g, or t
  modified_base (469)..(469): a, c, t, g, unknown or other
  misc_feature (469)..(469): n is a, c, g, or t
  modified_base (561)..(561): a, c, t, g, unknown or other
  misc_feature (561)..(561): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcgttttaagaggtgtccagtgtcagatgcaactgggcggaggtcggggggagcgtggtccgaggccggggaatcccngacgactctcctgtgcgagtcgtccgcgtccaccttcgtcgtttggctattcacgtcggtccncaggcctcgaggcgaagggcgtggagtgggtggcggtnagtagtgggtggactggaagtagtgacttagtttngacaggcctcgggtgaacgggtccactcgacagtcaccgagacggcaggtaccctaccgaaacgtaaccttacctttttaanacgttagtaaccgttaagtaacggaaaccgtcgacgtacgtaccggaccgtacgtacgtctagtaactacgttcggtcggcgggtacggtanacggaacggaccggtcgggtccggccgtacggacggctaacgggttcggccgg

SEQ ID NO: 334242 - DNA, 620 bp, Homo sapiens
  misc_feature: GZ8MTXP01A3R9O.25.35.D02.1.454.CMB.2.raw
  modified_base (397)..(397): a, c, t, g, unknown or other
  misc_feature (397)..(397): n is a, c, g, or t
  modified_base (477)..(477): a, c, t, g, unknown or other
  misc_feature (477)..(477): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcgggaggtcggggggagcgtggtccgaggccggggaatccctgagactctctgtgcagtcgtccgcgtccaccttcgtcgtttggctattcacgtcggtcccgccgaggcctccgaggtacgaaggggactgggaggtgggtggcggtcagtagtgggtggataggaagtaatgtaacttattttgngacagtaccgtcgtaggaacgggccactcaccatcctaccgagacggctacgacctaaccgaaacgtaacctacttttancctagtactaaagttacgaaaaccgtgagacctacggacgtaccgacggtcttcgtaactagttacgcggttcggtacgggtacttaaggaacgaacggtcgggtaccgggtccgtacgtacgggctaaggttcggaaccggg

SEQ ID NO: 334243 - DNA, 588 bp, Homo sapiens
  misc_feature: GZ8MTXP01CRB10.25.35.D02.1.454.CMB.2.raw
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttctttaagaggtgtccagtgtcagatgcaactggcggaggtcggggggaggcgtggtccaggccggggaatccctgagactctcctgtgctagtcgtccgcgtccaccttccgtcgtttgcattcacgtcgggtccnccagggcctccgagggaccaaaggggacgtggagggtggggtggcggttnagtagtgggtgggatggaataagngactaattttngcaaggacctccgtaggaaacgggccgactcaccatctacccaaggaggcagactacaaagaactacctttatcgtagtacaattagaaaaccgtgaacgactaacgacaacgtacggcctggtctaagttcgtagccgtcggggtcttaggaagacgtgggtacgggccgttacgcggactgttcgggaaccg

SEQ ID NO: 334244 - DNA, 613 bp, Homo sapiens
  misc_feature: GZ8MTXP01BAE3O.25.35.D02.1.454.CMB.2.raw
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (472)..(472): a, c, t, g, unknown or other
  misc_feature (472)..(472): n is a, c, g, or t
  modified_base (554)..(554): a, c, t, g, unknown or other
  misc_feature (554)..(554): n is a, c, g, or t
  modified_base (562)..(562): a, c, t, g, unknown or other
  misc_feature (562)..(562): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcgggaggtcggggggagcgtggtccaggccggggaatccctgagtactctcctgtgcagtcgtccgcgtccaccgttccgtcgtttggctattcacgtgggtcccnccgagcctcaggcaaagggctggagtgggtggcggtnagtagtgggtggatggaagtatggacttaatttgtgcagacctaccggtaggaaacggggtcccacgttcaaccatccaccgaggacggcagcctaacgaaacgtaccttaacgttttacnctagtactaaacgtttagaaaacccgtgactacgtacgaacgtacgtacgtcgtgttctacgttacgcggccggcgggttanacgggaanaaccggtggggtcccgggccgttacgacggacgaacggttcggaacccggg

SEQ ID NO: 334245 - DNA, 611 bp, Homo sapiens
  misc_feature: GZ8MTXP01AGQA5.25.35.D02.1.454.CMB.2.raw
  modified_base (310)..(310): a, c, t, g, unknown or other
  misc_feature (310)..(310): n is a, c, g, or t
  modified_base (385)..(385): a, c, t, g, unknown or other
  misc_feature (385)..(385): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttctttaagaggtgtccagtgtcagatgcaactggcggaggtcgggggagcgtggtccaggccggggaatccctgagcctctcctgtgcagtcgtccgcgtcccaccttccgtcgtttggctattcacgtgggtcccnccgaggcctcgaggcaaaggggtctgggagtggggtggcgtcatagtgggtggatgggaatatgacttagttttngacagtacctcgggtaggaaacgggcccactccacctatccacgaggacgcacgcgtacaacgtaacctacttttagactagacctaagttacgaaaaccgtgacgtactaccgacgacgacggtctcgtaacgtaacttacgcggttccggtacgggggttcagggaaacggaccggtaacgggtcggggaacctacggtacggacgtcggttcgggaacccggg

SEQ ID NO: 334246 - DNA, 628 bp, Homo sapiens
  misc_feature: GZ8MTXP01ED9NM.25.35.D02.1.454.CMB.2.raw
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
  modified_base (489)..(489): a, c, t, g, unknown or other
  misc_feature (489)..(489): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagaggtgtccagtgtcagatgacaacgtgggcggagggtcggggggagcggtggtccgaggccggggaatccctggacgtactctcctgtcgcgtagtcgtcccgcgtccctaccgttccgtgtttgctattcacgtcggcccgccaggcctcgaggacgaagggctggaggtgggnggcgttnagtagnggtacggataggaatatgactatttgngacgagtaccgtcggtagggaacgggccctactcaacctatccgaccgagacggcaacgtaccctaacaaacgttaaccttactttttacncgttaacgtaactaaacgtacggaaacgtgaacgtaccgacgacgtacgtcgtctgtaactagttcggcgggttcggtcgggtacaaggacggaccgggtcggggtccggcgtacgacggacgtcggttccggaaccgg

SEQ ID NO: 334247 - DNA, 617 bp, Homo sapiens
  misc_feature: GZ8MTXP01DWE8W.25.35.D02.1.454.CMB.2.raw
  modified_base (262)..(262): a, c, t, g, unknown or other
  misc_feature (262)..(262): n is a, c, g, or t
  modified_base (390)..(390): a, c, t, g, unknown or other
  misc_feature (390)..(390): n is a, c, g, or t
  modified_base (472)..(472): a, c, t, g, unknown or other
  misc_feature (472)..(472): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggagcgtggtccaggccgggaatccctgagactctctggtgcngtgtccgcgtccaccttccgtcgttttggctattcacgtcggtccgccaggcctccgaggcaagggctgggagtgggtggcgtcagtgtggtggatagggaagtaagtgtaacgttaatttttaacgngtacgaacgtacgtcccggtagggaacggggcccactcaccactctaccgagacggcagcctacaaacgaaccttactttancgtagacctaaagttacgaaaccgtgaacgacgtacgacgtacgcgtctgtaaccttattacgcgttccgggacgggttacgaggaaacgaccggtcggggtccgggaacccgtcgtaccgggctaacgggttcgggaacccggg

SEQ ID NO: 334248 - DNA, 650 bp, Homo sapiens
  misc_feature: GZ8MTXP01C0FIK.25.35.D02.1.454.CMB.2.raw
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
tcagactgtacagtcacgaccggtgctcgatttagcacacgatagttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcatggaaccagccgtgacattggtncttataactntgtctcctgtcccaanaacaccaggcaacgccccaaancatctattatgatgtcagtcatccggtccctcgttaggtacgtttcgtggtcgtcctttctacgtcggtcctacccgtaaacgttctcggtactaaaccgtccggtcccctcccgtcgaccctagtcccgtcggggcctccgaggccgtggacggacgacgtacgttaacttattaattcgtactacgtttactaacttacaacggacaaccaccgtaaactaggtaccgttgggttacggttcgggacgggtaacgggtaacccttaggttaccggaccgttaccgttccgggacaccggccccgaaaggtccctccggtaccccccgttcgggttacccttaaccgttccgtttcccccgg

SEQ ID NO: 334249 - DNA, 572 bp, Homo sapiens
  misc_feature: GZ8MTXP01BFCKF.25.35.D02.1.454.CMB.2.raw
  modified_base (182)..(182): a, c, t, g, unknown or other
  misc_feature (182)..(182): n is a, c, g, or t
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
  modified_base (450)..(450): a, c, t, g, unknown or other
  misc_feature (450)..(450): n is a, c, g, or t
  modified_base (486)..(486): a, c, t, g, unknown or other
  misc_feature (486)..(486): n is a, c, g, or t
  modified_base (521)..(521): a, c, t, g, unknown or other
  misc_feature (521)..(521): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatgggagtttgggctgcgctgggttttcctcgttgctcttttaagnggtgtccagtgtcagatgcaactggcggaggtcggggggagcgtggtccaggccgggggaatccctgagactctcctgtgcagtgtccgcgtccaccgttcgtcgtttggctattcactgggtcccnccaggcctccgaggcaagggctgggagtgggtggcggtcagtagtgggtgggataggaagtaatgaacttattttngcagacctcgtggaacgggcccgatcaccatctccgagacggcagcctacaagactacttttacncgtagaactaagtacgaaacgtgacgtacacggacncgtacgtcttgtaactcttcgtggttcggcggtanacggacggacggcggggtccgggccgtcggacggcgtaacggttcggaacg

SEQ ID NO: 334250 - DNA, 635 bp, Homo sapiens
  misc_feature: GZ8MTXP01BY5HG.25.35.D02.1.454.CMB.2.raw
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (494)..(494): a, c, t, g, unknown or other
  misc_feature (494)..(494): n is a, c, g, or t
  modified_base (562)..(562): a, c, t, g, unknown or other
  misc_feature (562)..(562): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtctgggttttcctcgttgcttcttttaagaggtgtccagtgtcagatgcaacgtggcgggaggtcggggggaggcggtggtccgaggccggggaagtccctgagctctcctgtgcagtcgtccgcgtccaccttcgtcgtttgctattcacgtcgggtccgccgaggcctccgaggcaagggggacgtgggaggtggggtggcggtcagtagtgggtggagtaggaacgtaangtaactaattttaagngccaggtaccgtccggtaggaaacgggggcccaactcgaaccctatcctccgaaggacggcagcccgtacaaacgtaaccttaccttttacncgtagtactaaagttagaaaacccgtgaacgaccgtacgacgactacggctgttaaccgtattaccgngccggtcggggtcttaaggaacgaaccgggaagggtcccggggccttcgaccggctaaggttcgggaacccgg

SEQ ID NO: 334251 - DNA, 763 bp, Homo sapiens
  misc_feature: GZ8MTXP01D4WET.25.35.D02.1.454.CMB.2.raw
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
tcagactgtacagtcacgaccggtgctcgatttagcacacgatagttgggtttggggggggtctcaggaggcagcactctcgggacgtctccaccatggcctgggctctgctcctcctcagccctcctcactcagggcacaggatccctggctcagtctgccctgactcagcctcgctcagtcgtccgggtctccgtggacagtcagtcaccntctcctgcactggaaccagaagtnatcgttggtgcttatgacactgtctccgtggccaaccgtagtttaaccccaaggaaaaccgcccccaagacgtcagttacctttatgatggtacgaggaacgccggtccccgtacggaccggggttccctggtacgttcgtctttccgtcgttacgggtaccaagttccgtacgggtaacccaaacccgtacccgggtccccttaccccgtacgtaacccctacgttccgtaccggttcggggtaccttcccggaaagggtccgttaaggggacgggtacgttagggacgggtacttaggttaaacgtttttaatttaagtttcggttaacctttggtttaccttaagttagtacgtacggtaacgggtaaccttaaacgtttaccggttaaggtttttttcggggttgggtttcccgggacgtaacccgggtaacggggttaacccgttaggttttaccgggaacccgtttccgggtttcgggtacccgaccggttacccgtaacgggttccccgttcccccggg

SEQ ID NO: 334252 - DNA, 645 bp, Homo sapiens
  misc_feature: GZ8MTXP01EBV37.25.35.D02.1.454.CMB.2.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (350)..(350): a, c, t, g, unknown or other
  misc_feature (350)..(350): n is a, c, g, or t
  modified_base (473)..(473): a, c, t, g, unknown or other
  misc_feature (473)..(473): n is a, c, g, or t
tcagactgtacagtcacgaccggtgctcgatttagcacacgatagttgggtttggggggggtctcaggaggcagcactctcgggacgtctccaccatggcctgggctctgctgttcctcaccctcctcactcagggcacagggtcctgggcccagtctgccctgactcagcctgcctccgtgtctgggactcctggacagtcggtcactatttccngcactggaaccngcatgatgttgcttacttgaccttgtctcttgtacaacaacaccganaagctacaactctataatttganacagtaagcgcctgtgggtttcagtgattcactggctcaagtctggacaacnccggaccctaccctaacaatctcgtcgggtctaccgaggtctagaaagaccgtagggtcttaggtttattttccgtgtcgttgtgacgttatgtacggtactaaagtaaaacttagtttcggngtcggtacggcgggaacggtaccctaaagttcgtaaccgttcgttaaaagtcccgaaacggtacccgttaaggtcccgtcccggttcccccgttcgggttacccctaaccggtttcccttcccggtttacccccctaaccccgttcccttaacccttaaccggtttaacccg

SEQ ID NO: 334253 - DNA, 647 bp, Homo sapiens
  misc_feature: GZ8MTXP01A4DIV.25.35.D02.1.454.CMB.2.raw
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (503)..(503): a, c, t, g, unknown or other
  misc_feature (503)..(503): n is a, c, g, or t
  modified_base (570)..(570): a, c, t, g, unknown or other
  misc_feature (570)..(570): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcggggggagcggtggtccaggccggggaatccctgacgactctccgtgtgcagtcgtccgcgtccaccttcgtcgtttggctattccgacgtcgggtccnccgaggcctccgaggccaaggggtctgggagtggggtggcggtnagtagtgggtggactggaaagtatggtctaattttagcgtacaggtacccgtcgggtaggaaacggggtcccaactcccacctatccgtacccgaaggacggaccaggtacccttaaccgaaagttaaccctacctttttaancgtagtaactaaagtaacgaaaccgtgaacgaccgtacggaacgacgtcgtctcgtctaacgttcgnggccgggttcgggtactaggaaacggttcggcggggtaaccgggtccgtcggacggcgttacggtcggccggtccgg

SEQ ID NO: 334254 - DNA, 667 bp, Homo sapiens
  misc_feature: GZ8MTXP01AJCQX.25.35.D02.1.454.CMB.2.raw
  modified_base (389)..(389): a, c, t, g, unknown or other
  misc_feature (389)..(389): n is a, c, g, or t
  modified_base (433)..(433): a, c, t, g, unknown or other
  misc_feature (433)..(433): n is a, c, g, or t
  modified_base (523)..(523): a, c, t, g, unknown or other
  misc_feature (523)..(523): n is a, c, g, or t
  modified_base (595)..(595): a, c, t, g, unknown or other
  misc_feature (595)..(595): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatgggagtttgggctgcgtcttgggttttcctcgttgcttcttttaagaggtgtccagtgtcagatgcaacgtgggcgggaggtcggggggaggcggtggtccgaggccggggaacgtcccgtgacgtacctcctccgtgtcgctagtcgtcccgcgtcccaccttccggttcgtttcggctacgttccacgtcgggtcccgccgacggccctaccgaggacgaaggggcgtgggaggtggggtcggcggtanagtggtggtacgggatagggaagtaagtgtaacttattttaagngacgacggtaccgtcggtaggaacgggcccacgtacaccctatccgtaccgaggacggcacgacctaacgaaactaaccttacgttttanaccgtagtaactaaacgttacgaaaccgtcgaacgtaccgtacgacgtaccgtagtctgtaactcgttacgnggaccgtcgggtacacggaacgaccggtaaggggtcccgggtcgtcggacgccgtaagttcgggaacccggg

SEQ ID NO: 334255 - DNA, 712 bp, Homo sapiens
  misc_feature: GZ8MTXP01AL6JZ.25.35.D02.1.454.CMB.2.raw
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (321)..(321): a, c, t, g, unknown or other
  misc_feature (321)..(321): n is a, c, g, or t
  modified_base (423)..(423): a, c, t, g, unknown or other
  misc_feature (423)..(423): n is a, c, g, or t
tcagactgtacagtcacgaccggtgctcgatttagcacacgatagttgggtttggggggggtctcaggaggcagcactctcgggacgtctccaccatggcctgggctctgctcctcctcagcctcctcactcagggcacaggatcccgggctcagtctgccctgactcagcctcgctcagtcgtccggtctcctggacagtcagtcaccatctcctgcactggaaccagaagtgatcttggtntcttatgactactgtcncctggccacctacgttttaacccgaaggaaaaccgtcccccaagtacgtcacttcctttangtatgtcgaggaacgccggccctcgacggggtccctgactcgtcttcgtcgtcggtaaccaaatccgagacccaacgacccggtccctccctacgaaccctnttcccgtcgtcgggtcccttccgacggtccgttagggagtacgtaggtaggtaccttaggtaaacgttttatttaagtttcggtcctttaggttacctaaagtgttacggacgtacgggtacctaaaacccgttcgtttaagggttttgggttcggtttaccggacccgggttacggaaaccggggttaaaccccgttagggttaccggttaaccccggttttccgggaccgggttcggaaccccggttacccggaaccgggtcccgttcccccggtttcccccccggg

SEQ ID NO: 334256 - DNA, 623 bp, Homo sapiens
  misc_feature: GZ8MTXP01ADVCN.25.35.D02.1.454.CMB.2.raw
  modified_base (314)..(314): a, c, t, g, unknown or other
  misc_feature (314)..(314): n is a, c, g, or t
  modified_base (400)..(400): a, c, t, g, unknown or other
  misc_feature (400)..(400): n is a, c, g, or t
  modified_base (484)..(484): a, c, t, g, unknown or other
  misc_feature (484)..(484): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcgggggagcgtggtccgaggccggggaagtccctgacgacctctcctgtgcagtcgtccgcgtcccaccttcgtcgtttggctattccacgtgggtcccnccgaggcctccgaggcgaaggggactgggagtggggtggcggtcagtagtgggtagggataggaagttaatggtaactatttttgngacgagtacgtccggtaggaaacgggcccacctcaaccgtatccaccgagacggcacgtcctaccaaagtaacctaccttttancgtagactaataacgaaaaccgtgaacgacctacggaaccgacacggtctcgtaactacgtttacgcggcggtacgggtacttaggaacggacgtaacgggggccgggccgtacgtcggacgtaacgttcgggaacccg

SEQ ID NO: 334257 - DNA, 654 bp, Homo sapiens
  misc_feature: GZ8MTXP01DI5NL.25.35.D02.1.454.CMB.2.raw
  modified_base (310)..(310): a, c, t, g, unknown or other
  misc_feature (310)..(310): n is a, c, g, or t
  modified_base (614)..(614): a, c, t, g, unknown or other
  misc_feature (614)..(614): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggagcgtggtccaggccggggaagtccctgagactctctgtgcagtcgtccgctccaccgttccgtcgtttggctattcacgtgggtcccnccaggctccgaggcgaagggctgggagtggtggcggtcagtagtgggtcggagtagggaagtaatggaacttatttttaagcgactaggtacctccgggtagggaacgggcccgactaccgaccaactcctaccgaggaacggccacggtaccttaacccgaaacgtaaaccttaccttttttaacacgttacgtaaccgttaaacgttaacggaaaaacccgtgaacgtaaccgtacgaaccgaccgacggtcttggtaaccctagttacgtggcggtacgggtcttaggaacgttaaccggngggtacccgggcctcggacggctaacggttcgggaacccg

SEQ ID NO: 334258 - DNA, 742 bp, Homo sapiens
  misc_feature: GZ8MTXP01BU5NO.25.35.D02.1.454.CMB.2.raw
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (394)..(394): a, c, t, g, unknown or other
  misc_feature (394)..(394): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggtttttcctcgttgcttcgttttaagaggtgtccagtgtcagatgcaacgtggcggagggtcggggggaggcggtggtccgaggccgggggaagtccctgagacctctcctgtgcngtcgtccgcgtccnccttccgtcgtttgcattcncgtggtccncaggctccaggcgaagggctgggagtgggnggcgtcagtagtggtgggagtaggaagtaatggtaaacttattttgngaccacggtaccgttccgggtaagggaaacggggcccctaactaccaaccctatccgtacccgaaggaacgggacctaccgaccttaacccgaaaacgtaaaccctttaacctttttacaccgttaacggtaacctaaaacgtttaaccggaaaaccgtcgaaacgtaacccgtacggaacgaccgtaacggtcccttaggttaacttaaacgtttccggcgggaccgggttcccgggggtaattaacggggttaaaacggaaccggggttaaccggggggttcccgggggtaaccccgtttacgggtaacccgggggttacgaacgggttccgggggtaaccccggg

SEQ ID NO: 334259 - DNA, 633 bp, Homo sapiens
  misc_feature: GZ8MTXP01BK1R4.25.35.D02.1.454.CMB.2.raw
  modified_base (307)..(307): a, c, t, g, unknown or other
  misc_feature (307)..(307): n is a, c, g, or t
  modified_base (389)..(389): a, c, t, g, unknown or other
  misc_feature (389)..(389): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaatccctgagactctcctgtgcagtcgtccgcgtccaccttcgtcgttttggctattcacgtcgggtccnccaggcctccaggcaagggctgggaggtgggtggcggtcagtagtcgggtggatagggaagtaatggacttaagttttaagngtacgtacgtacgtccggtaggacgggtacccactaccacctatccgtaccgaggacgcacgcctaaccgaaacgtaacttactttagcgtagtaactaaagttacgaaaccgtgaacgtacgtaccgacgtacgacgtctcgtaactaagttcgtcggccggtacgggtacgttaacggaacggttaccgggtaaggggtcccgggtccgtaccggtacgggacctaacggttccgggaaccg

SEQ ID NO: 334260 - DNA, 710 bp, Homo sapiens
  misc_feature: GZ8MTXP01DBCYK.25.35.D02.1.454.CMB.2.raw
  modified_base (151)..(151): a, c, t, g, unknown or other
  misc_feature (151)..(151): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
tcagactgtacagtcacgaccggtgctcgatttagcacacgatagttgggtttggggggggtctcaggaggcagcactctcgggacgtctccaccatggcctgggctctgctcctcctcagcctcctcactcagggcacaggatcccgggntcagtctgccctgactcagcctcgctcagtgtccggtctcctggacagtcagtccacatctctgcactaggaaccagaagtgatcttggtntcttangacactgtcnctgcactagtttaccaagaaacgccccagagtcactccttatgtatgtacaggaagccggcctcgacggggtccctggactccggcttcgtacgtggtaacccaaattcgacgggacaaaccgaccgggccccttcccgtacgaacccctaagttccttcgtaacgggggccttaccccgaaagggtcccgtagggtaacggtaaacgggtacggtaacgtacgttacgttaacgtttaacggtttaacgtttacggttacgttacgttacgttaacgttaacgtacgtaacgtaacgtaaccgttaaacgttaacgtttacggttttaacgggtttcgggttaccggtaccggttaacggtaaacggtaaccggttaacggttaccggttacccggttaaccggtaccggtaaccgtaccgtacccgttaccggtcccgttcccgtccccg

SEQ ID NO: 334261 - DNA, 621 bp, Homo sapiens
  misc_feature: GZ8MTXP01CQYUL.25.35.D02.1.454.CMB.2.raw
  modified_base (307)..(307): a, c, t, g, unknown or other
  misc_feature (307)..(307): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (380)..(380): a, c, t, g, unknown or other
  misc_feature (380)..(380): n is a, c, g, or t
  modified_base (543)..(543): a, c, t, g, unknown or other
  misc_feature (543)..(543): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggtttttcctcgttgcttcttttaagaggtgtcagtgtcagatgcaactgggcggagtcggggggagcgtggtccaggccggggaatccctgacgacttctcctgtgcagtcgtccgcgtcaccttcgtcgtttggcagttcactggtccncaggctccaggcaaagggctggacgngggnggcgtnatagnggtgggatggaagtaatcgtataatttttaancgtacacgtacgtacggaggaacgggacccgactaccaacctaactcctaccgaaggacggaccacgacctaacctaaacgtaaacttaacctttatacgtacgtaactaaagtaacgaaaacgtgaacgacgtacgacgacgacgtctacgtaactattcgnggttcggcgggtattacggaacgaacggtcggggtacccggggtccgtacggtaccggacgtaacggttcggaaccgg

SEQ ID NO: 334262 - DNA, 632 bp, Homo sapiens
  misc_feature: GZ8MTXP01A0VRP.25.35.D02.1.454.CMB.2.raw
  modified_base (151)..(151): a, c, t, g, unknown or other
  misc_feature (151)..(151): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (285)..(285): a, c, t, g, unknown or other
  misc_feature (285)..(285): n is a, c, g, or t
  modified_base (406)..(406): a, c, t, g, unknown or other
  misc_feature (406)..(406): n is a, c, g, or t
tcagactgtacagtcacgaccggtgctcgatttagcacacgatagttgggtttggggggggtctcaggaggcagcactctcgggacgtctccaccatggcctgggctctgctcctcctcagcctcctcactcagggcacaggatcccgggntcagtctgccctgactcagcctcgctcagtgtccggtctcctggacagtcagtcaccatctctgcactggaaccngaatgatcttggtncttangacactgtctcctggcctacctagtttacccaaggaaacncccccagacgtcatccttatgatgtcgaggaacgccggaccctcgacggggtccctgaccgtccgtcgttctcgtcgggtaacctaaacgtcgtacgggaccaacgacccggccttcccgnaccctatccgtcgtacgggcctccgaaggtccgaggacggtagtcgggaaggtccttagttaatttaatttagttccggtttcttacgttacgtagtagtacgtacgtaacgtaacgtaacttacgttaggtttcgggttcggttcggtacggacggtacggtaacgttacggttcggttaccggtccggtcggtcgaccgaccgaccggtccgttcccgtccccg

SEQ ID NO: 334263 - DNA, 816 bp, Homo sapiens
  misc_feature: GZ8MTXP01A8HRW.25.35.D02.1.454.CMB.2.raw
  modified_base (344)..(344): a, c, t, g, unknown or other
  misc_feature (344)..(344): n is a, c, g, or t
  modified_base (390)..(390): a, c, t, g, unknown or other
  misc_feature (390)..(390): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttacttttaaggaggtgtccagtgtcagatgacaacgtgggcgggagggtcggggggagtcggtcgggtccgagggcccgggggaatcccgtggacgtacttctcctgtcgcgtagtcgtccgccgtccctacctttccggttcgtttggctattccgacgtcgggtcccnccgaggtcctccgaggccgaaaggggctgggagtgggtcggcggtntagtaggtgggtgggtaagtaggtaaacgttaagtcgtaaacttaagtttttaagcggtacgtaaacgggtaccgttaccggggtaacgggaaaccgggggtccctaaccttaccgaaccccgtacttaccccgacccggaaaggggaccggaacccgtaacggtaccccgttaaaccccaaaaacggggttaaacccctttaacctttttttaaccgaccgggttacggtaaaacgttaaaccgttaaacgggaaaaaaccgttcgaaacggttacccgtaaccggaacgtacccgtacgtccgttagtaaccttacggttacgtccgggccgggtacggggttacaacggaaacggttacccggtaacgggggtcccgggtcgttacgggaccggttccgtaaggggttccgggaaccccgggg

SEQ ID NO: 334264 - DNA, 597 bp, Homo sapiens
  misc_feature: GZ8MTXP01CHM9P.25.35.D02.1.454.CMB.2.raw
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (390)..(390): a, c, t, g, unknown or other
  misc_feature (390)..(390): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgtcttgggttttcctcgttgcttcttttaagaggtgtccagtgtcagatgcaacgtgggcgggaggtcggggggagcgtggtccaggccggggaatcccgtgagactctcctgtgcagtgtccgcgtccaccttcgtcgtttggctattcacgtgggtcccnccgaggctcgaggcgaagggctgggaggtgggtggcggtnagtagtgggtcggatgggaacgtatgactagttttngcagtactccgtggaacggccactcacatccgtacagacgcacgctaccaagtactactttagctgtactaagttacgaaaccgtgaacgacctacggaacgtaccgacggtctcgtcgtaattccggcggcggtaccggggtcagggttaacggacggtcggggttaccggggcctcggtaccgggctaagggttcggaacccggg

SEQ ID NO: 334265 - DNA, 552 bp, Homo sapiens
  misc_feature: GZ8MTXP01CBX4X.25.35.D02.1.454.CMB.2.raw
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
  modified_base (442)..(442): a, c, t, g, unknown or other
  misc_feature (442)..(442): n is a, c, g, or t
  modified_base (495)..(495): a, c, t, g, unknown or other
  misc_feature (495)..(495): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggaggcgtggtccagccggggaagtccctgagactctcctgtgcagtgtccgcgtccacctccgtcgtttggcattcactgggtccnccaggctccgaggcaagggactgggagtggggtggcggtcagtagtggggtgggatgggaaagtaatgctaattttangcaagactccgtagaacggggccactcaccatctcagagcagctaccaagaactactttanctaggactaaattacgaaaaccgtgagactcgaacgacacggctgctaatacngcgcgggtctagaacgacgacgggtcggggcctcgtacggcagtcgggccgtccggg

SEQ ID NO: 334266 - DNA, 751 bp, Homo sapiens
  misc_feature: GZ8MTXP01AI9WU.25.35.D02.1.454.CMB.2.raw
  modified_base (327)..(327): a, c, t, g, unknown or other
  misc_feature (327)..(327): n is a, c, g, or t
  modified_base (377)..(377): a, c, t, g, unknown or other
  misc_feature (377)..(377): n is a, c, g, or t
  modified_base (428)..(428): a, c, t, g, unknown or other
  misc_feature (428)..(428): n is a, c, g, or t
tcagactgtacagtcacgaccggtgctcgatttagcacacgatagttgggtttgggggagctctgggagaggagcccagcactagaagtcggcggtgtttccatccggtgatcagcactgaacacagaggactcagcatggagtttgggctgcgctgggttttcctcgttgcttactttttaagaggtgtccagtgtcagatgcaactgggcggaggtcggggggagcgtggtccgagccgggggaatccctgagactctccgtgtgcgtagtcgccgcgtacctacccgttccggttcttttaggctagtttccacgtgggtcccnccgaggctacccgaggacgaaaggggctaggaggtgggggtcgaccggtnaagttgaggggtcgggagtacggaaaggttaatggaaacttagtttttaancggtaccaaggtaccgttccggtaggaaacgggggtccccacttacgaaacccaattccgacccgaaggaggacctaaggaccttaacccgaaaagttaaaccctaacctttttaatcggtaggacttaaaacgttacggaaaaaccgtggaaacttaccgtacgggaacctaaccggtaacgggcccttaaggttaaccgttaattaaacccgttgggaacccggtggggggttaaaccccagggaaaagaacccgggttaaaccgggggtcgggggaaccgccgggttaacccgggaacgtaacggttcggggtaaccggg

SEQ ID NO: 334267 - DNA, 531 bp, Homo sapiens
  misc_feature: GZ8MTXP02H1YGQ.25.35.D02.1.454.CMB.2.raw
  modified_base (240)..(240): a, c, t, g, unknown or other
  misc_feature (240)..(240): n is a, c, g, or t
tcagactgtacagtcacgaccggtgctcgatttagcacacgatagttgggtttgggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtncttatgacactgtctcctggcaccagttttaccccaggaaaacgcccccagagtcatcctttatgatgtcaggaagcggccctcacggggtccctgactcgcttctctggtccaaatctggcaacacggccctcctgaccatctctgggctccagctgagatgagctgattattattgctgttcatatgcagctaactatattttggtgtttcggcgtcaacggggtacctaaaggttcgaaccgttccgtacggggttcacggtcccgaacgggtccttacggtcccccg

SEQ ID NO: 334268 - DNA, 500 bp, Homo sapiens
  misc_feature: GZ8MTXP02HTCC2.25.35.D02.1.454.CMB.2.raw
  modified_base (225)..(225): a, c, t, g, unknown or other
  misc_feature (225)..(225): n is a, c, g, or t
tcagactgtacagtcacgaccggtgctcgatttagcacacgatagttgggtttgggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccngaagtgatcttggtgcttatgacactgtctcctggcaccagtttacccaggaaaagcccccagagtcatccttatgatgtcaggaagcggccctcgaggggtccctgactcgcttctctggtccaatctgcacacgcctcctgacccatctctggctccagctgagatgagctgattattatttgctgtctatatgcagcactactatttgttggttcgtcgcgacggaccgagtacgtacgtccgtcggtcgacgccgaacgcgtcgtcccccg

SEQ ID NO: 334269 - DNA, 673 bp, Homo sapiens
  misc_feature: GZ8MTXP02HVKY8.25.35.D02.1.454.CMB.2.raw
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
  modified_base (372)..(372): a, c, t, g, unknown or other
  misc_feature (372)..(372): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtcgtttggcattcactgggtccnccaggctccaggcaagggctggagtgggtgcggtanatagtggtggataggaagtatgacttatttagngacacgacgtaccgtacggaacgggaccgacctaccaaccactacctacccgacgacggacgacgaccgtaacccgaaacgtaaacctaaacctttaacttacttacgtactaaacgttaaacgtaaaaccgtaacggtaacgaaccgtaaccggaaccggaaccgaaccggtaccgttacgttacgttaacttacgtacggtaccgggtaccggggtaccggtacggtaaacggaaacggtaacggggtaccgggggtacccgggtaccggtaccggtaccggtacggtacgggtaccgg

SEQ ID NO: 334270 - DNA, 551 bp, Homo sapiens
  misc_feature: GZ8MTXP02HB07H.25.35.D02.1.454.CMB.2.raw
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (401)..(401): a, c, t, g, unknown or other
  misc_feature (401)..(401): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtccaccttccgtcgtttggcattcactgggtccnccaggctccaggcaagggactggagtgggtggcggtcatagtggtgggatgggaagtaatgcattttgngcagtactcgtagacgggccactcacatcncagacgcagcacaatactactttanctnactaattacgaaaccgtgacgtacgtacgacgacgacggtctgtactagttacgtcggcggtcgggtactacggaacgacggaaggggtccgggtaccgtacgacggacgacggtcggaccg

SEQ ID NO: 334271 - DNA, 547 bp, Homo sapiens
  misc_feature: GZ8MTXP02GMT6G.25.35.D02.1.454.CMB.2.raw
  modified_base (376)..(376): a, c, t, g, unknown or other
  misc_feature (376)..(376): n is a, c, g, or t
  modified_base (441)..(441): a, c, t, g, unknown or other
  misc_feature (441)..(441): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggaggcgtggtccagccggggaagtccctgagactctcctgtgcagtgtccgcgtccaccttccgtcgtttggcattcactgggtccgccaggcctccgaggcaaggggactggagtggggtggcggtcatagtggtgggatggaagtaatgctattttngcagactccgtgaacgggccactcaccatcctccagacggcagcctacaaagaactaccttttanctgacaattagaaaaccgtgaagactcgaacgacacggctgtactattctcggcggcggggtctagaaagacgaagggtcggggccgtcgtacggcagtcggaccg

SEQ ID NO: 334272 - DNA, 609 bp, Homo sapiens
  misc_feature: GZ8MTXP02ICON1.25.35.D02.1.454.CMB.2.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtccaccttccgtcgttttggctattcactgggtccncaggctccaggcaagggactgggagtggggtggcggtcatagtggtgggatgggaagtaatggctatttttagngtacacgtccgtcggaggacggccactacactactcgacgagacgacacgacctaacgaaacgtacctttaacctttactacgtacgtaacttaacgtaaaccggaaacgtacgaacgtaccgacgaaccgacgtacgtcgtacgttactacgtacggcggtacgggtcggtacgaacggaacgacgggtcggggtaccggtacgtacggacgacgtacggacggccgg

SEQ ID NO: 334273 - DNA, 526 bp, Homo sapiens
  misc_feature: GZ8MTXP02FWPDT.25.35.D02.1.454.CMB.2.raw
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (427)..(427): a, c, t, g, unknown or other
  misc_feature (427)..(427): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtccaccttccgtcgtttggcattcactgggtccncaggctccaggcaagggctggagtggggtggcggtcagtagtggtgggatggaagtaatgctattttngcagactccgtgaaacgggccactcaccatctccagagcagctcaagactactttanctgacaattacgaaaaccgtgacgactcgaacgacacggctgtctatacncgcgcggggtctagaagacgngggtcgggctcgacggcacgtcggaccg

SEQ ID NO: 334274 - DNA, 586 bp, Homo sapiens
  misc_feature: GZ8MTXP02HK41V.25.35.D02.1.454.CMB.2.raw
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtcgtttggcattcactgggtccnccaggcctccaggcaagggctggagtggggtgcggtcatagtggtgggatgggaagtaatgctatttttagngacagtacctcgtaggaacggcccgactccacctactcctaccgagacgacacgacctaaccaaacgtaaccttaccttttatctacgactaaagttacgaaaaccgtgaacgacgtacgacgacgacggtctacgtactacttacgcgcggtacgggtacacggaaacgacggaacgggtccgggaccgtacgacggctacgtcggaccg

SEQ ID NO: 334275 - DNA, 562 bp, Homo sapiens
  misc_feature: GZ8MTXP02H0TBO.25.35.D02.1.454.CMB.2.raw
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtcgtttggcattcactgggtccgcagggctccaggcaagggctgggagtgggtggcgtcatgtggtggatggaatatgctatttgngcagctcgagaacggccactcacntcacgagacgcagcacaagactactttanctagactaagttacgaaacgtgaacgactacgacgacgacggcttacgtactagttacgcggtccggtacgggttactaacggaaacgtacggtaacggggttccggggacccgtacgtaaccggacgtacggtacgggaccg

SEQ ID NO: 334276 - DNA, 606 bp, Homo sapiens
  misc_feature: GZ8MTXP02JLN4P.25.35.D02.1.454.CMB.2.raw
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (437)..(437): a, c, t, g, unknown or other
  misc_feature (437)..(437): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtcgtttggcattcactgggtccncaggcctccgaggcaagggactggagtggggtggcggtcagtagtgggtggggatggaagtaatgctattttngcagactccgtagaacgggccgactcaccatctccagagcagctacaagaactacctttanctgacaattacgaaaaccgtgaacgacctacggaaccgacgtaaccgggtctacggttacctaatttaccgtcggtccgggtacgggggttacctagggtaaacggaacggtaacgggggtttcgggggacccgttacggtaccgggacgtaacggtcgggaacccggg

SEQ ID NO: 334277 - DNA, 576 bp, Homo sapiens
  misc_feature: GZ8MTXP02JE07X.25.35.D02.1.454.CMB.2.raw
  modified_base (464)..(464): a, c, t, g, unknown or other
  misc_feature (464)..(464): n is a, c, g, or t
  modified_base (505)..(505): a, c, t, g, unknown or other
  misc_feature (505)..(505): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaactggcggaggtcgggggagcggtggtccaggccggggaagtccctgacgactctcctgtgcagtgtccgcgtccaccttccgtcgtttggctattcacgtgggtcccgccagggcctccgaggcaaaggggctgggagtggggtggcggtcatagtggtgggatgggaatatggctatttttagcgacagtacctccgtagaaacggggcccaactcaaccctatcctaccagacgcagcctaccaaagaactacctttanctgacaaattagaaaaccgtgaacgactacgacgacacggntgtactattacgcggcggtcgggtctacggaagacgaacgggtcgggacgtacgacggcacggtcggaccg

SEQ ID NO: 334278 - DNA, 539 bp, Homo sapiens
  misc_feature: GZ8MTXP02JHJOK.25.35.D02.1.454.CMB.2.raw
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
tcagactgtacagtcacgaccggtgctcgatttagcacacgatagttgggtttggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggncttatgacactgtctcctggcacctagtttacccaaggaaacgcccccagacgtcatcctttangatgtcagagcggcctcgagggtccctgactcgcttctcgtcggtaccaaatctggacaacgaccggccctccctgacccatctctgggcctcaggctgagatgagctagattattatgcttgttacatatgacaggcaaactactagttttggtgtttcggcgcgtaacggggacctaaaggttcgtaaccgtccgtttcgggaccacggacccaacggtccgaccgtcccccg

SEQ ID NO: 334279 - DNA, 537 bp, Homo sapiens
  misc_feature: GZ8MTXP02F38IE.25.35.D02.1.454.CMB.2.raw
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttgggtncttatgacactgtctcctggcacctagtttacccagaaaacgcccccagagtcatccttatgatgtcaggaagcggccctcgaggggtcccctgactcgcttctctggtaccaaatcgtggacaaacgaccggcctccctgacccatctctgggctccaggctgagatgagtntatattattatntntntatatatgcgagactaactacttagtttaggttcgtcggtcgacgtacggtacgtacgttacgtaccgtaaccgtcggtacgacgaccgacgaccgtccgtcccg

SEQ ID NO: 334280 - DNA, 525 bp, Homo sapiens
  misc_feature: GZ8MTXP02HGEZP.25.35.D02.1.454.CMB.2.raw
  modified_base (384)..(384): a, c, t, g, unknown or other
  misc_feature (384)..(384): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgattcgttggtgcttatgacactgtctcctggcaccagttttacccaggaaacgcccccagagtcatcctttatgatgtcaggaagcggccctcgacggggtccctgactccgcttctcgtcggtccaaatctcggcaacaccgccctcccngaccatctctggctcagctgacgatgagctagattattattgctattcatacagtagacaccaacagtctaggtcgttcgggcggaggaccgtacgttcgaccgttccgcggtcacgtccaaggtcctccgccccgtccgg

SEQ ID NO: 334281 - DNA, 628 bp, Homo sapiens
  misc_feature: GZ8MTXP02IS09V.25.35.D02.1.454.CMB.2.raw
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaatccctgagactctcctgtgcagtgtccgcgtccaccttccgtcgtttggcattcactggtccncaggctccaggcaagggctggagtggggtggcgtcatagtggtgggatgggaaataatgactatttttagngactagtaccgtccggtaggaaacgggcccactccaacctactcctaccgaaggacgccagaccctaaccgaaagtaaccttacctttatctacgtaactaaacgttaacggaaaacccgtgaacgtaccgtaccggaaccacgaccggtctacgttactaagttaccgtcggtaccgggtacgggtactaacgggaaacgaaccgggtaacggggtccggggaccgttacgaccggcgtacggtacggaccgg

SEQ ID NO: 334282 - DNA, 600 bp, Homo sapiens
  misc_feature: GZ8MTXP02J0YPF.25.35.D02.1.454.CMB.2.raw
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
  modified_base (464)..(464): a, c, t, g, unknown or other
  misc_feature (464)..(464): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtccaccttccgtcgtttggctattcactgggtccnccaggctccgaggcaagggctggagtggggtggcggtcagtagtgggtggggatgggaagtaatgactattttagngacacgtacgtccgtaggaacgggcccgactccacctactcctaccgagacggcacgcctaccaaacgtaaccttacctttanctagactaagttaacgaaaaccgtgaacgtacgtacgacgacgacggtctagtactacgttacgcggccgggtcgggtactacggaacggacggtcggggtccggggaccgtacggtaccggcgtacgtcgggacg

SEQ ID NO: 334283 - DNA, 574 bp, Homo sapiens
  misc_feature: GZ8MTXP02JAHFY.25.35.D02.1.454.CMB.2.raw
  modified_base (384)..(384): a, c, t, g, unknown or other
  misc_feature (384)..(384): n is a, c, g, or t
  modified_base (448)..(448): a, c, t, g, unknown or other
  misc_feature (448)..(448): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggtggaggtcggggggaggcggtggtccaggccggggaagtccctgagactctcctgtgcagtgtccgcgtccaccttccgtcgtttggctattcacgtcgggtccgccaggctccgaggcgaagggctgggagtggggtggcggtcagtagtgggtggatgggaagtatgactatttgngcagactccgtagaacgggccactcaccatccacagacgcagcctacaaagacctaccttttanctagactaagttagaaaacccgtgacgactcgaacgacgacggtctagttactagttaccgtggccggtacgggggtctaaggaacgaacgaacggggtccgggactcgacggcaggtcggaccgg

SEQ ID NO: 334284 - DNA, 581 bp, Homo sapiens
  misc_feature: GZ8MTXP02I9G2I.25.35.D02.1.454.CMB.2.raw
  modified_base (390)..(390): a, c, t, g, unknown or other
  misc_feature (390)..(390): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtgggtccaggccggggaagtccctgagactctcctgtgcagtgtccgcgtccaccttccgtcgttttggctattcacgtcgggtcccgccagggcctccgaggccaaggggctggggagtggggtggcggtcagtagtgggtgggatgggaataatgctattttngcagtacctccgtgaaacggggccactcaccctatcctccagacggcagctaccaagacctaccttttanctanactaagttacgaaaccgtgacgactacgacgacgacgtctatactagttacgcggcggtcgggtcaacggaacgacggcggggtccgggacctacggtacggctacggacggaccgg

SEQ ID NO: 334285 - DNA, 486 bp, Homo sapiens
  misc_feature: GZ8MTXP02JPKUE.25.35.D02.1.454.CMB.2.raw
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (421)..(422): a, c, t, g, unknown or other
  misc_feature (421)..(422): n is a, c, g, or t
  modified_base (424)..(424): a, c, t, g, unknown or other
  misc_feature (424)..(424): n is a, c, g, or t
tcagactgtacagtcacgaccggtgctcgatttagcacacgatagttgggtttgggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgcttatgacactgtctcctggcaccagtttaccccaggaaagcccccagagtcatccttatgatgtcaggaagcgccctcaggggtccctgactcgcttctctggtccaaatctggcacacgcctccctgaccatctctggctccgngcngngngngngntntntatntntntntntntntnngnactatattgtgtgtcgcgacgacgtacgtacgtcgtcgtcgtcgacgacgacgcgtcgtccg

SEQ ID NO: 334286 - DNA, 545 bp, Homo sapiens
  misc_feature: GZ8MTXP02IRB0T.25.35.D02.1.454.CMB.2.raw
  modified_base (306)..(306): a, c, t, g, unknown or other
  misc_feature (306)..(306): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
  modified_base (494)..(494): a, c, t, g, unknown or other
  misc_feature (494)..(494): n is a, c, g, or t
  modified_base (515)..(515): a, c, t, g, unknown or other
  misc_feature (515)..(515): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggaggcgtggtccaggccggggaagtccctgagactctcctgtgcagtgtccgcgtccaccttccgtcgtttgctattcactgggtcccncaggctccaggcaagggctggagtgggtggcggtcagtagtggtgggatggaagtatgctatttgngcagacctccggngaacgggccactcaccatccnccagacggcagcctaccaagaacctaccttttanctagactaattcgaaaacccgtgacgactcgacgacacggctgtactattacgngcggcgggtctaggagaacgnggtcggggacctacgacggctagtcggacg

SEQ ID NO: 334287 - DNA, 597 bp, Homo sapiens
  misc_feature: GZ8MTXP02IJNIX.25.35.D02.1.454.CMB.2.raw
  modified_base (310)..(310): a, c, t, g, unknown or other
  misc_feature (310)..(310): n is a, c, g, or t
  modified_base (389)..(389): a, c, t, g, unknown or other
  misc_feature (389)..(389): n is a, c, g, or t
  modified_base (465)..(465): a, c, t, g, unknown or other
  misc_feature (465)..(465): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaagtccctgagactctcctgtgcagtgtccgcgtccaccttccgtcgtttggctattccacgtcgggtcccnccaggcctccgaggccaaggggactgggagtggggtgcggtcagtagtgggtgggataggaagtaatgacttattttgngacagacctccggtagaaacgggcccgactcgaaccatcctaccgagaggcagcctaccaagtaacctacctttanctagtactaagtacgaaacgtgaacgacgacgacgacgacgtctacgtactacgttcgcggtccggtacgggtactacggaaacgacggtaacggggtccggaccgtacggacggtcgtacggtacggaccg

SEQ ID NO: 334288 - DNA, 681 bp, Homo sapiens
  misc_feature: GZ8MTXP02H5DSP.25.35.D02.1.454.CMB.2.raw
  modified_base (304)..(304): a, c, t, g, unknown or other
  misc_feature (304)..(304): n is a, c, g, or t
  modified_base (381)..(381): a, c, t, g, unknown or other
  misc_feature (381)..(381): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaagtccctgagactctcctgtgcagtgtccgcgtccaccttccgtcgtttggcattcactgggtccncaggctccaggcaagggctgggagtgggtggcgtcagtagtgggtgggatgggaagttaatggtactaagtttttangggtactaaggtacccttccggtaggaacgggggccctaacgtccaacccgattcccgtacccgaaggacgggacctacggaccctaacccgaaaacgtacccttaacccgttttttatccttacggacctaaaagtttacggaaaaaccgttgaaacgtaccgtacggaaccgaacgtaccgggtctacgtaccttaacttacgttcggaccgggtccgggggttactagggaaaacgtaacgtcgggggtccgggggcccgttacggaaccgggcaacggttcgggaaccgtcccggg

SEQ ID NO: 334289 - DNA, 614 bp, Homo sapiens
  misc_feature: GZ8MTXP02G0C31.25.35.D02.1.454.CMB.2.raw
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
  modified_base (453)..(453): a, c, t, g, unknown or other
  misc_feature (453)..(453): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccaggccggggaagtccctgagactctcctgtgcagtgtccgcgtccaccttccgtcgttttggctattcacgtgggtcccgccaggcctccgaggccaagggactggagtggggtgcggtnagtagtggtgggatggaagtaagtgactatttgngcagtacctccgtggaacgggcccgactcaccgatcgtccagagcagctaccaagtacctaccttttanctagtactaattacggaaaaccgtgaacgactacgacgacgacggtctagtacttacgttacgtcggtccgggtacgggggttactacgggaaacgaacggtaagggggtcccgggggtaccgttaccggtacgggaccgtaacggtcggggaaccccggg

SEQ ID NO: 334290 - DNA, 543 bp, Homo sapiens
  misc_feature: GZ8MTXP02JGXFZ.25.35.D02.1.454.CMB.2.raw
  modified_base (242)..(242): a, c, t, g, unknown or other
  misc_feature (242)..(242): n is a, c, g, or t
  modified_base (434)..(434): a, c, t, g, unknown or other
  misc_feature (434)..(434): n is a, c, g, or t
tcagactgtacagtcacgaccggtgctcgatttagcacacgatagttgggtttggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttgggtncttatgacactgtctcctggcaccagtttacccaggaaacgcccccagacgtcatccttatgatgtcaggagcgcctcgagggtccctgactcgtcttctcgtcggtaccaatcgtgacaaacgccggcctccctgaccactctctggctccagctgagatgagctgtattattagtgcttgtacatatcgngacggactaactactaagtttacggttggttacggttcggtacgacggtacgtaacggtaacgtaccgtaacgtcggtcgtacgaccgaacgaccgtaccgtcccccgg

SEQ ID NO: 334291 - DNA, 601 bp, Homo sapiens
  misc_feature: GZ8MTXP02JF097.25.35.D02.1.454.CMB.2.raw
  modified_base (180)..(180): a, c, t, g, unknown or other
  misc_feature (180)..(180): n is a, c, g, or t
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagnggtgtccagtgtcagatgcaactggcggagtcgggggagcgtggtccaggccgggaatccctgagactctcctgtgcagtgtccgcgtccaccttccgtcgtttgcattccactggtccncaggctccgaggcaaggctgggagtgggtggcggtcattagtgggtggatgggaaagtaatggtctaagttttanggacaggtacctccggtagaacggggccctaacgtccaaccctatccgaccgagacggacacgcctaaccaaagtaacctacctttttagcttagactaaattacgaaaaccgtgaacgactacgacgtacacggtctgtacttacgtacgtcggacgtcggggtactacggaaacgtaacggagggtccggggacctacggacggcacggtcgggaccgtccggg

SEQ ID NO: 334292 - DNA, 588 bp, Homo sapiens
  misc_feature: GZ8MTXP02JMN5L.25.35.D02.1.454.CMB.2.raw
  modified_base (306)..(306): a, c, t, g, unknown or other
  misc_feature (306)..(306): n is a, c, g, or t
  modified_base (381)..(381): a, c, t, g, unknown or other
  misc_feature (381)..(381): n is a, c, g, or t
  modified_base (448)..(448): a, c, t, g, unknown or other
  misc_feature (448)..(448): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaatccctgagactctcctgtgcagtgtccgcgtccaccttccgtcgttttggcattcactgggtcccnccaggcctccgaggcaaggggctgggagtgggtggcggtcatagtggtggggatgggaaataatgactattttgngacagtcctcggtaggaacgggccactccacactcacagagcacgcctacaagtaaccttactttanctagactaatacgaaacgtgaacgactacgacgacgacgtctcgtactagttacgcggtcggtacggggtactacggaacggaaccggtaacggggtacccggggtaccgttacggacggaccgtacggtacgggaccgg

SEQ ID NO: 334293 - DNA, 610 bp, Homo sapiens
  misc_feature: GZ8MTXP02HSSZG.25.35.D02.1.454.CMB.2.raw
  modified_base (178)..(178): a, c, t, g, unknown or other
  misc_feature (178)..(178): n is a, c, g, or t
  modified_base (307)..(307): a, c, t, g, unknown or other
  misc_feature (307)..(307): n is a, c, g, or t
  modified_base (384)..(384): a, c, t, g, unknown or other
  misc_feature (384)..(384): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggtttcctcgttgctctttaagnggtgtccagtgtcagatgcaactggcggaggtcgggggagcgtggtccaggccggggaagtccctgagactctcctgtgcagtgtccgcgtcccacctttccgtcgtttggcattcacgtggggtcccnccaggcctccgaggccaaggggctgggagtggggtggcggtcagtagtggggtggatgggaaagtatgctattttangacagtacgtccgtaggaacgggcctaactcaaccatctccgagacgcacgctacccaaagtaacctacctttaatcctagactaaattacgaaaaccgtgaacgactacggaacgacgaacggtctacgtctaaacgttcgtcgcggtccgggggttacacgggaaacgaacggtacgggtaaccggggtcgtacggtacggacgtacggtacggtacgtccggg

SEQ ID NO: 334294 - DNA, 598 bp, Homo sapiens
  misc_feature: GZ8MTXP02G0WN1.25.35.D02.1.454.CMB.2.raw
  modified_base (309)..(309): a, c, t, g, unknown or other
  misc_feature (309)..(309): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (416)..(416): a, c, t, g, unknown or other
  misc_feature (416)..(416): n is a, c, g, or t
  modified_base (452)..(452): a, c, t, g, unknown or other
  misc_feature (452)..(452): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggagcgtggtccaggccggggaagtccctgagactctcctgtgcagtgtccgcgtccaccttccgtcgttttggcattcacgtgggtcccnccagggcctccgaggccgaagggctgggagtggggtgcggtcagtagtggngggatgggaagtactgactatttttgngacagacgtaggagacggccactcacctnctacgagacgcagacctacaaactaccttactttanctacgtaactaacgttaacgaaaaccgtgaacgaccgtacgaaccgacgtaccgtcttacgttacttacgttacgcggtacgggtacggggtacacggaacgaacggcggggtcgggaccgtacgtacggacgtacggtcgggacg

SEQ ID NO: 334295 - DNA, 524 bp, Homo sapiens
  misc_feature: GZ8MTXP02HIAUA.25.35.D02.1.454.CMB.2.raw
  modified_base (241)..(241): a, c, t, g, unknown or other
  misc_feature (241)..(241): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtgatcttggtncttatgacactgtctcctggcaccagttttaccccaggaaaacgcccccagacgtcatcctttatgatgtcaggaagcgccctcgaggggtccctgactcgcttctctggtccaatctggcaacacgcctccngaccatcnctcggctccgagctgagatgagctgattatattgctgttcatatgacaggactaaactactagttttggtcgtttcggcgtcgacgggacctaagttcgaccgtcgtcgggtacacggacccaacggtccgtccgtcccccg

SEQ ID NO: 334296 - DNA, 725 bp, Homo sapiens
  misc_feature: GZ8MTXP02G1027.25.35.D02.1.454.CMB.2.raw
  modified_base (308)..(308): a, c, t, g, unknown or other
  misc_feature (308)..(308): n is a, c, g, or t
tcagactgtacagtcacgaccggtgctcgatttagcacacgatagttgggtttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagcccgtgacagttggtgctttaataactatgtctcctggtcccaacaacaccaggcaacggcccccaaatcatcatttatnatgtcagtcatccggaccctcgtggtacgtttcgtggttcgtcctttctcgtcggcctaccgtaagtcctgggtccaaaccgtccggcccttccccgtagacccctagttcccgtccgggggacccttcccgacgggccttggaacgggaccgaagggtccttaacctttaagtttacttggtaccttaatttctaattaaccagggaaccaacctaaacccgaaactacggttaccgttaggggttcggtttaccggggaccggggtaaacggggtaacccccgtaaagggtttaccggtaaaccccggttacccgttccggggttaacccaacgggtacccccgaaaacggggtccccgttacccggtcccccccggttaacgggtttccctaacctttcccgtttaccccccgg

SEQ ID NO: 334297 - DNA, 659 bp, Homo sapiens
  misc_feature: GZ8MTXP02GO2CH.25.35.D02.1.454.CMB.2.raw
  modified_base (308)..(308): a, c, t, g, unknown or other
  misc_feature (308)..(308): n is a, c, g, or t
  modified_base (396)..(396): a, c, t, g, unknown or other
  misc_feature (396)..(396): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaagtccctgagactctcctgtgcagtgtccgcgtccaccttccgtcgttttggctattcactcgggtccnccagggcctccgaggccaaggggactggaggtggggtggcggtcagtagtggggtagggatgggaaagtaagtcgtactatttttagngacacgtccgtacggtaggacgggcctactccaacctatccacgaggacggccaacgacctaaccgaaacgtaacctttaacctttacacgttacgtaactaaacgttaacggaaaaccgtacgaacgtaccgtacggaaacgaccgtaccggtcttagttacttacgttacggcgggtaccgggtacgggttacaacggaaacggtaccgggtcgggggtcccgggtaccgtacggtaccggacgtacggtaccgggaccgg

SEQ ID NO: 334298 - DNA, 630 bp, Homo sapiens
  misc_feature: GZ8MTXP02HFZMZ.25.35.D02.1.454.CMB.2.raw
  modified_base (384)..(384): a, c, t, g, unknown or other
  misc_feature (384)..(384): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccgggaagtccctgagactctcctgtgcagtgtccgcgtccaccttccgtcgttttggctattcactgggtccgcccagggcctccgaggccaaggggctgggagtggggtggcggtcatagtggtcgggatgggaagtatggactattttgngcagtacgtcggtaggacgggccactacacctatcctacgagacgcacgacctaaccgaaacgtaaccttaccttttataccgtacgtaacttaacgttaacgaaaaccgtcgaacgtaacgtacggaacgtacgacgtactacgttacttaacgttacgtcggacgggtacggggtactaacgggaacgtaaccgggtcggggtccggggtaccgtaccggaacggacgtacggtaccggaccgg

SEQ ID NO: 334299 - DNA, 537 bp, Homo sapiens
  misc_feature: GZ8MTXP02H29SP.25.35.D02.1.454.CMB.2.raw
  modified_base (377)..(377): a, c, t, g, unknown or other
  misc_feature (377)..(377): n is a, c, g, or t
tcagactgtacagtcacgaccggtgctcgatttagcacacgatagttgggtttggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctctgcactggaaccagaagtgattcttggtgcttatgacactgtctcctggcaccagttttaccccaggaaacgcccccagagtcatcctttatgatgtcaggaagcggccctcgaggggtccctgactcgcttctctggtccaaatcgtgacaacgacgcctcccngaccatctcgtggctcccagctgagatgagctgattattatgctgttcattatgtcaggctaacgtactagttttggtgtttcggcgtacgaacgggtaccctaaggttcgaacccgttccgtggggttaccacggtacccaacgggccttacgcccccg

SEQ ID NO: 334300 - DNA, 603 bp, Homo sapiens
  misc_feature: GZ8MTXP02IWAGH.25.35.D02.1.454.CMB.2.raw
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
  modified_base (475)..(475): a, c, t, g, unknown or other
  misc_feature (475)..(475): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggaggcgtggtccaggccggggaagtccctgagactctcctgtgcagtcgtccgcgtccaccttccgtcgtttgctattcacgtcgggtccnccgaggcctccgaggccgaaggggcgtgggagtggggtggcggtcagtagtggtgggataggaagtaatgacttattttgngacagtacctccgtaggaaacgggcccgactccaccgtactcctacccgagacggccagcctaccaaagaacttaccttttanctacgtacaaacgttagaaaaccgtgacgactcgaacgacacggctgtactattacgtggaccggtcggggtactaaggaacgaacgcggggtaccggggccgtacgtacggacacgtacggacccgg

SEQ ID NO: 334301 - DNA, 580 bp, Homo sapiens
  misc_feature: GZ8MTXP02G5RQ6.25.35.D02.1.454.CMB.2.raw
  modified_base (242)..(242): a, c, t, g, unknown or other
  misc_feature (242)..(242): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcgttggngtcttatgacactgtctcctggcacctagtttacccaaggaaaacgcccccagacgtcatccttatgatgtcaggaagcggccctcgacggggtccctgactcgtcttctcgtcgggtaccaaatcgtcgacaacgaccgcctccctcgacccatctcgtcgggcctccgaggctggaggagtgagtctagtattattagttgcttgtacatatcgacgacggacaaaccgttataggttttggtcggtttcgggcgacggtaacggggtacctaaacggttcgacccggtccgtacgggtaccgacggacccgtaacggcccgtccggtccccccgg

SEQ ID NO: 334302 - DNA, 618 bp, Homo sapiens
  misc_feature: GZ8MTXP02JAHDR.25.35.D02.1.454.CMB.2.raw
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (436)..(436): a, c, t, g, unknown or other
  misc_feature (436)..(436): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggaggcgtggtccgaggccgggaacgtccctgagctctcctgtgcagtcgtccgccgtcctaccgttccgtcgtttggctacttcacgtcgggtccgccaggcctccgaggcgaagggtcgtggagggtggggtgccggtnagtagtcggtgggatggaagtatgacttattttgngcaagtccgtccggtagacgggcccgactccacctactcnccagacgcacgtcctaccgaaacgtacctacctttactcgtacgtacaaacgtttacgaaaaccgtgaacgacgtaccgaacgtcgacgtctcgttacctagttacgtacgcgggtaccgggtataacggacgtaaacggcgggtaccgggtcgtacggtacgacgtacgtacgggacccgg

SEQ ID NO: 334303 - DNA, 649 bp, Homo sapiens
  misc_feature: GZ8MTXP02HUC2K.25.35.D02.1.454.CMB.2.raw
  modified_base (316)..(316): a, c, t, g, unknown or other
  misc_feature (316)..(316): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (482)..(482): a, c, t, g, unknown or other
  misc_feature (482)..(482): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggaggcgtggtccaggccggggaagtccctggagactctcctgtgcagtcgtccgcgtccaccttccgtcgttttggcatttccgacgtcggggtccnccagggcctccgaggcaagggctggagtggggtggcggtnagtagtgggngggatggaagtaatgctaatttttngcaagaccgtcgtagaaacgggtcccgaactcaacccagtcctccgaagacggccaagccctaacccgaaagtaaacctacctttttaacncgttagactaaattacggaaaaccgttgaacgactacggaacgaaccgacggtctcggttactaaactttacgcggaccggtcgggggttacctagggaaaacggaacggtaacgggggttcccggggacccgttcgtaaaccggccgtaaggttcgggaacccggg

SEQ ID NO: 334304 - DNA, 581 bp, Homo sapiens
  misc_feature: GZ8MTXP02ILQU4.25.35.D02.1.454.CMB.2.raw
  modified_base (372)..(372): a, c, t, g, unknown or other
  misc_feature (372)..(372): n is a, c, g, or t
  modified_base (442)..(442): a, c, t, g, unknown or other
  misc_feature (442)..(442): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtccaccttccgtcgttttggcctattcactgggtccgccaggctccgaggcaagggctggagtgggtgcggtcatagtggtgggatggaatatgactattttancgcagactccgtagaaagggcccgaactcacctatcctacagaggcagctaccaaagaactaccttttanctagactaatacgaaacgtgaacgactacgacgacgtacgtactacgttacttacgttacgcggtacggtacggggtactaacggaaacggaacggccggggtacgggtaccgtacgacggcgtaacggtacggaccgg

SEQ ID NO: 334305 - DNA, 549 bp, Homo sapiens
  misc_feature: GZ8MTXP02JACFC.25.35.D02.1.454.CMB.2.raw
  modified_base (433)..(433): a, c, t, g, unknown or other
  misc_feature (433)..(433): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggtttcctcgttgctcttttaagaggtgtccagtgtcagatgcaactggcggagtcgggggagcgtggtccagccgggaagtccctgagactctcctgtgcagtgtccgcgtccaccttccgtcgtttggcattcactgggtccgccaggctccaggcaagggctggagtggggtggcggtcagtagtgggtgggatggaagtaatggctatttatgtagactccgagaacgggccgactcaccatctaccagagcagctccaaagactacctttanctgactaattacgaaaccgtgaagacgtacgacgtacacggctgactacgtactcggcggcggggtctagaacgacgagggtcgggacctacgtacggcagtcgggaacgtccggg

SEQ ID NO: 334306 - DNA, 587 bp, Homo sapiens
  misc_feature: GZ8MTXP02GK7LZ.25.35.D02.1.454.CMB.2.raw
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactgggcggaggtcgggggagcgtggtccaggccggggaatccctgagctctcctgtgcagtgtccgcgtccaccttccgtcgtttggctattcactggtccnccaggctccgaggcaagggctggagtggggtggcgtnagtagtggngggatggaaacgtatgcttattttgngactagacgtcgagacggccacncacntcncagagcagcacaatactactttanctanactaagtacgaaaccgtgacgacgtacgacgacgacgtcttacgtacttagttacgtcggaccggggtacgggtactaacgggaaaacggtaacgggtaaccgggggtcccggggtaccgttaccggacggacgtacggtacgggaaccgg

SEQ ID NO: 334307 - DNA, 636 bp, Homo sapiens
  misc_feature: GZ8MTXP02GVGR2.25.35.D02.1.454.CMB.2.raw
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (375)..(375): a, c, t, g, unknown or other
  misc_feature (375)..(375): n is a, c, g, or t
  modified_base (453)..(453): a, c, t, g, unknown or other
  misc_feature (453)..(453): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaagtccctgagactctcctgtgcagtgtccgcgtccaccttccgtcgttttggcattcactgggtccnccaggctccgaggcaagggctggagtgggtggcgtnagtagtggtgggatggaagtatgctatttttgngctagacctccgtaggaacgggcccactcaccagtcctaccaggacggccagctaccgaaagtaaccttaccttttanactgacctaaagtttacggaaaacccgttgaacgtacctcggaaaccgaccgtacgggtcttacggttaccttaagtttaccgtggtaccgggtccgggggttactacggaaacggtaaccggtaacgggggtcccgggggtacccgttacggtaccgggcgtaacggttcggggaaccccgg

SEQ ID NO: 334308 - DNA, 545 bp, Homo sapiens
  misc_feature: GZ8MTXP02IZZ6J.25.35.D02.1.454.CMB.2.raw
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgattcttggtgcttatgacactgtctcctggcacctagtttacccagaaacgcccccagagtcatcctttatgatgtcaggaagccgccctcgacggggtccctgactcgtcttctctcgggtccaaatcgtgcaacaccgccctcctgacccatctcgtggctccagctgagatcgagctgatttatattgctgttcatatgcagcaatactagttttggtgtttacgggcgtacgagggtacccgtaaaaggttcgaacccggtccgttggggtacctaacggcccgaaacggtcctaccggttcccccgg

SEQ ID NO: 334309 - DNA, 664 bp, Homo sapiens
  misc_feature: GZ8MTXP02HI9ZI.25.35.D02.1.454.CMB.2.raw
  modified_base (392)..(392): a, c, t, g, unknown or other
  misc_feature (392)..(392): n is a, c, g, or t
  modified_base (472)..(472): a, c, t, g, unknown or other
  misc_feature (472)..(472): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccaggccggggaagtccctgacgactctcctgtgcagtcgtccgcgtccaccgttccgtcgtttggctattcacgtgggtcccgccaggcctccgagggcaagggctgggaggtggggtggcggtcagtagtgggtgggatagggaagtaatgactattttagngctagaccgtccgtaggaaacggggcccacgtccaaccctatcctaccagaggccagcctaccaaagtaccttacctttncctagacctaaagttacggaaaacccgttggaacgtacctaccggaacgacgtaccgggtcttacggttaccttagtttaccgtcgggtccgggtaccgggggttacctagggaaaaccggacgggtaacgggggttccccgggggtaccgttaccggtaacgggtccctaagggttaccggggaccccggg

SEQ ID NO: 334310 - DNA, 588 bp, Homo sapiens
  misc_feature: GZ8MTXP02HJ7F7.25.35.D02.1.454.CMB.2.raw
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (471)..(471): a, c, t, g, unknown or other
  misc_feature (471)..(471): n is a, c, g, or t
tcagactgtacagtcacgaccggtgctcgatttagcacacgatagttgggtttggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcgtggtntcttatgacnctgtctctggcactacgtttaccaaggaaacgcccccagacgtctactccttatcgtatgtcgaaggacgcgccctcgtacgggtccctgactcgtcttcgtcgtcggtaccaactcgtcggacaaacgccgccttcccgacgaccctactctcgtcggcctcgaggtctggaggtagtggacggtctaggtatttaagtcgttgtcttgttacaatgtnacgaggacctaacgttactgttttggtcggtttacggcgtaccggtaacgggtacctaaacggttccggaacgttccgtcggggtacaccgaccgacggtcccgtaccgtcccccgg

SEQ ID NO: 334311 - DNA, 586 bp, Homo sapiens
  misc_feature: GZ8MTXP02J0V3W.25.35.D02.1.454.CMB.2.raw
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
  modified_base (435)..(435): a, c, t, g, unknown or other
  misc_feature (435)..(435): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtcgtttggcattcactgggtccgccaggcctccaggcaaggggctgggagtggggtggcggtcatagtgggtgggatgggaagtaatgactattttagngacagcgtcgaggacggccactcacntcacgagcgcagctacaagtactactttanctagactaagtacgaaacgtgaacgtacgtacgaacgacgacggtcttacgttactacgttacgcggtccgggtacggggttactaacgggaaacggaacggtaacgggggtcccggggaccgtacggtaccggcgtacggtcgggaccgg

SEQ ID NO: 334312 - DNA, 695 bp, Homo sapiens
  misc_feature: GZ8MTXP02JH6N0.25.35.D02.1.454.CMB.2.raw
  modified_base (307)..(307): a, c, t, g, unknown or other
  misc_feature (307)..(307): n is a, c, g, or t
  modified_base (389)..(389): a, c, t, g, unknown or other
  misc_feature (389)..(389): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccgggaagtccctgagactctcctgtgcagtgtccgcgtccaccttccgtcgttttggctattcacgtgggtcccnccaggcctccgaggccaaggggactgggagtggggtgcggtcagtagtgggtgggatgggaaagtatggacttaatttttgngcagtaccgtccggtaggaaacggggcccgtaacgtccaaccctagtccgtacccaggacggccaaggcctacccaaagtaaccttaaccgttttatccgtagacctaaagtttacggaaaaacccgtgaaaccgtaccgttacggaaccgtacgaacggggtccttagggttaccttaagtttaccgtacgggtccggggtccgggggttaccttaaggggaaaacggttaaaccggaacgggggttacccggggtacccggttacggtaacccggggaccgtaaggttccgggggaaccccggg

SEQ ID NO: 334313 - DNA, 555 bp, Homo sapiens
  misc_feature: GZ8MTXP02HYMWR.25.35.D02.1.454.CMB.2.raw
  modified_base (305)..(305): a, c, t, g, unknown or other
  misc_feature (305)..(305): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtcgtccgcgtccaccttccgtcgtttggctattcacgtgggtccnccaggcctcaggcaagggctgggagtgggtggcgtcatagtggtggatggaagtatgctatttangcagactcgtagacgggccactcaccatctcagngcagctacaagactactttanctgactaattagaaaaccgtgaacgacctacgacgacacggctagtactacttacgtggccgtcggggtactaggaacgaacgcggggtaaccggggcctacgtacggctaaggtcgggaaccgtccggg

SEQ ID NO: 334314 - DNA, 593 bp, Homo sapiens
  misc_feature: GZ8MTXP02F4VG4.25.35.D02.1.454.CMB.2.raw
  modified_base (308)..(308): a, c, t, g, unknown or other
  misc_feature (308)..(308): n is a, c, g, or t
  modified_base (392)..(392): a, c, t, g, unknown or other
  misc_feature (392)..(392): n is a, c, g, or t
  modified_base (470)..(470): a, c, t, g, unknown or other
  misc_feature (470)..(470): n is a, c, g, or t
  modified_base (558)..(558): a, c, t, g, unknown or other
  misc_feature (558)..(558): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcgggaggtcggggggaggcgtggtccgaggccggggaagtccctgagactctcctgtgcagtgtccgcgtccaccttcgtcgtttgctattcactggtccnccaggcctccgaggcaaggggctgggagtggggtggcggtcagtagtgggtggagtagggaaagttaagtgacttaatttttangacaaggtacctccggtaggaaacgggcccgaactcgacccatctccgagagcagctaccaaagtacctaccttttanctagactaacgttaggaaaaccgtgacgactacgaacgacacggctaggtctacttacgcggtcggacgggtactacggaagaaccgnggggtccgggacgtcgtacggctacgtcggaccgg

SEQ ID NO: 334315 - DNA, 599 bp, Homo sapiens
  misc_feature: GZ8MTXP02JZ5FJ.25.35.D02.1.454.CMB.2.raw
  modified_base (377)..(377): a, c, t, g, unknown or other
  misc_feature (377)..(377): n is a, c, g, or t
  modified_base (461)..(461): a, c, t, g, unknown or other
  misc_feature (461)..(461): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtccaccttccgtcgttttggcattcactgggtccgccaggctccgaggcaagggctggagtggggtggcggtcatagtggtggggatgggaagtaatgctattttgngacagtacgtccggtaggaacgggcccgactccaccactccgaccgaggacgcacgcctaccgaaacgtaaccttaccttttanctagactaagttacgaaaaccgtgaacgtaccgtacgacgaccgacggtctacgtacttacttacgcggtccggtcgggtacacggaacggacggtcggggtcccggggaccgtacgtaccggcgtacggtcggccgg

SEQ ID NO: 334316 - DNA, 561 bp, Homo sapiens
  misc_feature: GZ8MTXP02FSEOU.25.35.D02.1.454.CMB.2.raw
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtcccaccttccgtcgtttggcattccactggtccncaggctccaggcaagggctgggagtgggnggcggtcatagtggtgggatggaatatgctagttttangcagactcgtagaagggccactcaccatcncagngcngcncaagactctttanctnactaagtacgaaacgtgacgtacgtacgacgacgacgtcgtcgtactaacgtacgtcggccggtacggggttactacggaacgacggtacgggtccggggtaccgtacggaccggacgtacggtcggaccgtccgg

SEQ ID NO: 334317 - DNA, 618 bp, Homo sapiens
  misc_feature: GZ8MTXP02JASZU.25.35.D02.1.454.CMB.2.raw
  modified_base (286)..(286): a, c, t, g, unknown or other
  misc_feature (286)..(286): n is a, c, g, or t
  modified_base (389)..(389): a, c, t, g, unknown or other
  misc_feature (389)..(389): n is a, c, g, or t
  modified_base (425)..(425): a, c, t, g, unknown or other
  misc_feature (425)..(425): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgtcttatgacactgtctcctggcacctagtttacccaaggaaacncccccagacgtcattcctttatcgtatgtcaagggaacgccggccctcgacgggtccctgacctcgcttctcgtggtaccaatcgtgacaacgaccgcctccncgaccatctcgtcgggcctcgagctgagagtgacgngtagtatttattagttgtcttgttacattagtcgacgtacggaccttaaacgttacgttaagtttttcgggtacggtttccggacggtaccggtaaacgggtacccgttaaaacggttcggtaacccccggttcggtcggggttacccgtaacccgggtacccgaaacggtccgttaaccccggttccccccg

SEQ ID NO: 334318 - DNA, 527 bp, Homo sapiens
  misc_feature: GZ8MTXP02IKJFH.25.35.D02.1.454.CMB.2.raw
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
tcagactgtacagtcacgaccggtgctcgatttagcacacgatagttgggtttggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccngaagtgatcttggtgcttatgacactgctcctggcaccagttttacccaggaaagcccccagacgtcatccttatgatgtcaggaagcgcctnaggggtccctgactcgcttctctggtccaaatctgcaacacgcctcctgaccatctctggctcagctgagtagngagntagtattattattgtnttntacatagtgcgacgactaactacgttagtttggtacgttcggcgtacgacggtaccgtaacggttcgtaccgttaacgtcggtacacggacccgacggccgtaccgccccg

SEQ ID NO: 334319 - DNA, 582 bp, Homo sapiens
  misc_feature: GZ8MTXP02ISW23.25.35.D02.1.454.CMB.2.raw
  modified_base (424)..(424): a, c, t, g, unknown or other
  misc_feature (424)..(424): n is a, c, g, or t
  modified_base (452)..(452): a, c, t, g, unknown or other
  misc_feature (452)..(452): n is a, c, g, or t
  modified_base (541)..(541): a, c, t, g, unknown or other
  misc_feature (541)..(541): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccgggaagtccctgagactctcctgtgcagtgtccgcgtccaccttccgtcgttttggctattcactcgggtcccgccaggctccaggccaaggggactgggagtggggtggcggtcagtagtggtgggatggaagtaatgactattttgtgacagaccgtccggtaggaaacggggcccgactcaccctatcncagagccagcctacaagactacctttanctagactaattacgaaaaccgtgaagacctcgaacgacaacggctacgttctacttacgtcggacgcggggttcacgaacggtaaacgnggggtccggggccgttacgaccggcgtacgtacgggacccg

SEQ ID NO: 334320 - DNA, 570 bp, Homo sapiens
  misc_feature: GZ8MTXP02H1V8W.25.35.D02.1.454.CMB.2.raw
  modified_base (344)..(344): a, c, t, g, unknown or other
  misc_feature (344)..(344): n is a, c, g, or t
  modified_base (455)..(455): a, c, t, g, unknown or other
  misc_feature (455)..(455): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggagtcgggggagcgtggtccagccggggaatccctgagactctcctgtgcagtgtccgcgtccaccttccgtcgttttggctattcacgtcgggtccgccaggctccaggcaagggctggagtggggtggcggtnatagtgggtgggatgggaagtaatgactattttagtgcagacctccgggtagaaacggggtcccgactcaccctatcctccgagacggcagctaccaagactaccttttanctagactaattacgaaaaccgtgaagtactcgaacgacgacggtctggtactattacgtgcggacggggtctaggaacgacgaaggggtccgggactcgacggctagtcggaccg

SEQ ID NO: 334321 - DNA, 557 bp, Homo sapiens
  misc_feature: GZ8MTXP02J3I5I.25.35.D02.1.454.CMB.2.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (414)..(414): a, c, t, g, unknown or other
  misc_feature (414)..(414): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtnatcttggtncttatgacactgtctcctggcaccagtttacccaggaaacnccccagagtcatccttangtatgtcaggagcggccctcgacggggtccctgactccgcttctcgtcggtaccaaatctggaccaaacnccggccctccctagacccatcctcgtcgggctccgagctgagngtgagcgtgtattattatgtctgttctatattagcgacggactaactaacttaagtttaggttggttcggcggacggtacggtacgaacgtacgtaacccgtccgtcggtaccgacgacccgaacggtccgtccgtcccccgg

SEQ ID NO: 334322 - DNA, 577 bp, Homo sapiens
  misc_feature: GZ8MTXP02JXJ64.25.35.D02.1.454.CMB.2.raw
  modified_base (307)..(307): a, c, t, g, unknown or other
  misc_feature (307)..(307): n is a, c, g, or t
  modified_base (379)..(379): a, c, t, g, unknown or other
  misc_feature (379)..(379): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaactggcggaggtcggggggaggcgtggtccaggccgggggaatccctgagactctcctgtgcagtcgtccgcgtccaccttccgtcgtttgcattcactggtccncaggctccgaggcaagggctgggagtgggtggcggtcatagtgggtgggatgggaaagtagtgactattttnggcaaggtctcggtaggaaacgggcccactcaccatccgtcccagacggcacgcaccgtaagactaccgttttanctanactaagtacgaaacgtgacgtacgtacgacgacgacgctacgtactatacgcggccggcgggtacacggtaacgacggaacggggtccgggtccgtacgacggcgtacggtcggaccgg

SEQ ID NO: 334323 - DNA, 722 bp, Homo sapiens
  misc_feature: GZ8MTXP02HVI7J.25.35.D02.1.454.CMB.2.raw
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcgggggaggcgtggtccgaggccggggaagtcccgtgagacctctcctgtgcagtcgtccgcgtccaccttccgtcgttttggcattcacgtggtccnccaggcctccaggccaaggactggagtggggtggcggtcagtagtgggtgggatggaagtaatgacttattttgngaccagtaccttccggtagaaacggggcccgaactccgaaccctatccctaccgaaggtacggccaagtcctaacccgaaaacgtaaccttaaacccgttttttaacaccgttacgtaacctaaaacgtttaacggaaaaaaccccggttgaaacgtaaccgttacggaaacccgaacggtaaaccgggtcttacgggttaaccttaacgttttaaaccggcggtacccggggtacgggggttaccgtaacgggaaaacggtaaccggaacgggggttcccgggggtacccgttaccggtaacgggtaccgacgggtttacccgggaacccgggg

SEQ ID NO: 334324 - DNA, 642 bp, Homo sapiens
  misc_feature: GZ8MTXP02JO6AB.25.35.D02.1.454.CMB.2.raw
  modified_base (311)..(311): a, c, t, g, unknown or other
  misc_feature (311)..(311): n is a, c, g, or t
  modified_base (388)..(388): a, c, t, g, unknown or other
  misc_feature (388)..(388): n is a, c, g, or t
  modified_base (486)..(486): a, c, t, g, unknown or other
  misc_feature (486)..(486): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggagcgtggtccaggccggggaagtccctgagctctcctgtgcagtgtccgcgtccaccttccgtcgttttggctattccacgtcgggtccnccaggcctccgaggcaagggctggaggtggggtggcggtcagtagtggtgggataggaagtaatgactagttttagngctagtaccgtccggtaggaaacggggccctaacgtccaacctactccgtaccgaagaggcccaggtaccctaaccgaaagtaaccttaccctttaanctacgactaagttacggaaaacctgaacgacgtacgacgaccgacgtctagttccgtaagtttcgacgggtccggtacggggtacctaaggaacggtaacggaacggggtccggggtacccgttacggtacggaccgtacggtccgggtaacccgg

SEQ ID NO: 334325 - DNA, 578 bp, Homo sapiens
  misc_feature: GZ8MTXP02HYWMZ.25.35.D02.1.454.CMB.2.raw
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (403)..(403): a, c, t, g, unknown or other
  misc_feature (403)..(403): n is a, c, g, or t
  modified_base (430)..(430): a, c, t, g, unknown or other
  misc_feature (430)..(430): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactgggcggaggtcgggggaggcgtggtccaggccggggaagtccctgacgactctcctgtgcagtcgtccgctccaccttccgtcgtttggcattcactgggtccncaggctccgaggcaagggctgggagtggggtgcggtnatgtggtggganggaagtaatgctatttgngcagcctcgagacggccactcacactcncagagcacgcacaactaactactttanctagtactaagttacgaaacgtgacgactacggacgacgacgtctacgtacttagttaccgtcggtccgggtcgggtacgtacggaaacggaacgggtaacggggtacccggggaccgtacggaaccggacgtacggtaccgggaccg

SEQ ID NO: 334326 - DNA, 563 bp, Homo sapiens
  misc_feature: GZ8MTXP02F80WN.25.35.D02.1.454.CMB.2.raw
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttgggtntcttatgacactgtctcctggcacctagttttacccaaggaaaacncccccagagtcatccttatgatgtcaggaagccggccctcgaggggtccctgactcgcttctcgtgggtaccaaatcgtaggacaacgaccgccctccctacgacctactcctcgtcgggctccaggtctggagatgacgntgtattattattgctgttcattagngacgagactaactacgttagtttcggtcggtcggacgacggtaacggtacgtacgttcgtaccggtcgtcgggtaccgaccgaccgtacggtccctcccggtaccccg

SEQ ID NO: 334327 - DNA, 589 bp, Homo sapiens
  misc_feature: GZ8MTXP02I2BFZ.25.35.D02.1.454.CMB.2.raw
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (445)..(445): a, c, t, g, unknown or other
  misc_feature (445)..(445): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggttgtccagtgtcagatgcaactgggcggaggtcgggggaggcgtggtccaggccggggaatccctgacgactctcctgtgcagtgtccgcgtccaccttccgtcgtttgctattcactcgggtccncaggctccgaggcagggactgggagtggggngcggtnagtagtggnggatggaatatgacttattttncgcagtaccgtcggtaggaacgggcccactcaccatcacgagacggcagctacaagtactacctttanctagacctaagttacgaaaacccgtgaacgtactacgaacgcgaacggtcttagtacttacgttacgcggtcggtacggggtactaaggaaacgtacggaacggggttccggggactacggtacggcgtaagtacgggacccgg

SEQ ID NO: 334328 - DNA, 581 bp, Homo sapiens
  misc_feature: GZ8MTXP02HGGIW.25.35.D02.1.454.CMB.2.raw
  modified_base (311)..(311): a, c, t, g, unknown or other
  misc_feature (311)..(311): n is a, c, g, or t
  modified_base (385)..(385): a, c, t, g, unknown or other
  misc_feature (385)..(385): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggagcgtgggtccaggccggggaatccctgagctctcctgtgcagtgtccgcgtccctaccttccgtcgtttggctattcacgtcgggtcccnccaggcctccgaggcaaggggctgggaggtgggtggacggtcagtagtggtgggatgggaatatgacttatttngacagtacctccgtaggaaacgggcccactcaccatctcgagngcagctacaagactactttanctgactaattacgaaactgacgactcgacgacgacgtctgtacctagttacgtcggcggtcggggtactaggaaaccggtaacggtcgggggtccggggtacctaccggtaacggctacggtcgggacccgg

SEQ ID NO: 334329 - DNA, 528 bp, Homo sapiens
  misc_feature: GZ8MTXP02JSONO.25.35.D02.1.454.CMB.2.raw
  modified_base (150)..(150): a, c, t, g, unknown or other
  misc_feature (150)..(150): n is a, c, g, or t
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (443)..(443): a, c, t, g, unknown or other
  misc_feature (443)..(443): n is a, c, g, or t
tcagactgtacagtcacgaccggtgctcgatttagcacacgatagttgggtttgggggggtctcaggaggcagcactctcgggacgcctccaccatggcctgggctctgctcctcctcagcctcctcactcagggcacaggatcccgggntcagtctgccctgactcagcctcgctcagtgtccgggtctcctggacagtcagtcaccatctcctgcactggaaccagaagtgatcttggtncttatgacactgtctcctggcaccagtttacccaggaaacgcccccagagtcatcctttangatgtcaggagcggccctcgacgggtcctgactcgtcttctcgtggtaccaatctggcaacgaccggcctccctcgacccatcctcgtcgggcctccgaggctcggaggatgaggctaggtattattatgtctgttcatngcaggctaatctagtttcgtgttcggcgacgacgggtaccaggttccgaccgtcgtggtacacgaccgacggcctcgtcccccgg

SEQ ID NO: 334330 - DNA, 679 bp, Homo sapiens
  misc_feature: GZ8MTXP02GW9WP.25.35.D02.1.454.CMB.2.raw
  modified_base (315)..(315): a, c, t, g, unknown or other
  misc_feature (315)..(315): n is a, c, g, or t
  modified_base (517)..(517): a, c, t, g, unknown or other
  misc_feature (517)..(517): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcggggggaggcgtggtccaggccggggaagtccctgagactctcctgtgcagtcgtccgcgtccaccttccgtcgttttggctattccacgtcgggtccnccagggcctccgaggccgaaaggggtacgtgggaggtggggtggcggtcagttagtggggtaggggatagggaaacgttaagtgtacttaatttttagcgacgtaagtaccgttccgggtaggaaacgggcccgaaactccaaacccgtactcctaccgaggacggcacgaccctacgaaaacgtaaccttacccttttaanccgtagtaactaaacgtaacggaaaaccgtgaaacgtacgtaccggaacgaccgtacggtcttacgttactaacgttacggcggtaccgggtacgggtacaacggaaacggaccgggtaacggggtccgggaccgtacgtaccggcgtacggtacggcccgg

SEQ ID NO: 334331 - DNA, 766 bp, Homo sapiens
  misc_feature: GZ8MTXP02H5LUJ.25.35.D02.1.454.CMB.2.raw
tcagactgtacagtcacgaccggtgctcgatttagcacacgatagttgggtttgggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcgggggagcgtggtccaggccgggaagtccctgagactctcctgtgcagtcgtccgcgtccctaccgttccgtcggttttgcctagttcacgtcgggtccgccaggtcctccgaggacgaaggggactggggaggttggggtcggcggtcgtagtaggtgggtgggaagtggaaagtaacgtggtacttaatttttagcggtacacggttaccgtaccgggtacgggaaacggtccccaccgttaccaaccctaacgttcccgtacccgaaggggtacggccgtaaacggaccccctaaacccgggtaaaacgttaaaacccttaaacccgttttttactaccggttaacgtaaccttaaaaaccggttttaaaccgggaaaaaacccggttgaaaacccggtaccgttaaccggaacgaaaccgtaccgggtccttaacggtttactaactttcggcgtacccggggtcggggtacctaaggaacggtaaaccgggccggggttccggggaacccgtttcggaaccggccgtaacgttccggggaaccccgg

SEQ ID NO: 334332 - DNA, 679 bp, Homo sapiens
  misc_feature: GZ8MTXP02H1XZQ.25.35.D02.1.454.CMB.2.raw
  modified_base (400)..(400): a, c, t, g, unknown or other
  misc_feature (400)..(400): n is a, c, g, or t
tcagactgtacagtcacgaccggtgctcgatttagcacacgatagttgggtttgggggctctgggagaggagccccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccgggaagtccctgagactctcctgtgcagtgtccgcgtccacctttccgtcgttttggctattccacgtgggtcccgccagggcctccgaggccaaaggggctgggagttggggtggcggtcagtagtggggtgggatagggaaacgttaatggactagtttttaagnggtactaagtaccgtaccggtagggaacgggcccgtaacctccgaacctacgttcccgtaccgaaggacgccgacgtacctaacccgaaacgttaacccttaaccgtttttaatccgttacgtaacctaaagttaaccggaaaccgtagaacgtaaccgtaccgaacgaacgacggtactacgttacttacgttacgtcgggccgggtacggtacgtacggaaacgtaacggcggggtccgggaccgttacggacggacgtacggtaccggacgtccgg

SEQ ID NO: 334333 - DNA, 666 bp, Homo sapiens
  misc_feature: GZ8MTXP02GEJKA.25.35.D02.1.454.CMB.2.raw
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgtcttatgacactgtctctggcaccagtttacccaggaaacgcccccagagtcatcctttatgatgtcaagggagccggccctcgacggggtcccctgacctcgtcttctcgtcggtaccaaagtcgtcggcaaaccgaccggtccctacccgtacgaccctacgttctccgtcggggccttacccggacggtccttaggaggtaagtgggtaaggtccgttaggtaattttaatttaacgtttcggtcctttaggtttacctaatttaagttcgtacgaacgggtacctaaaccgttaacgttacggtttttgggttcggtttaccggggccgtacggtaacggggtaacccgtaaagggtttccgtacccggtccgtacgggtcgtaccgggtcccgaaacggtccgtaccggttccccccgg

SEQ ID NO: 334334 - DNA, 599 bp, Homo sapiens
  misc_feature: GZ8MTXP02HHBIG.25.35.D02.1.454.CMB.2.raw
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
  modified_base (383)..(383): a, c, t, g, unknown or other
  misc_feature (383)..(383): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaagtccctgagactctcctgtgcagtcgtccgcgtcccaccttccgtcgttttggcattccacgtggggtcccnccagggcctccgaggcgaagggctggaggtgggtggcgtnagtgtggtggatggaagtatgactattttgngactagtcgtcggagacggccactcacctctctacgagacgcacgacctacgaactaaccttactttatctagtactaagtacgaaacgtgacgtacgtacgaccgacgtacgtacttcgtacttacgtacgtcgggtaccggtacgggtacgtaacggaacggaaccggtcgggggtcccgggtaccgtacggtacggcggtacggtcgggaccg

SEQ ID NO: 334335 - DNA, 570 bp, Homo sapiens
  misc_feature: GZ8MTXP02HQGVA.25.35.D02.1.454.CMB.2.raw
  modified_base (382)..(382): a, c, t, g, unknown or other
  misc_feature (382)..(382): n is a, c, g, or t
  modified_base (454)..(454): a, c, t, g, unknown or other
  misc_feature (454)..(454): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaatccctgagactctcctgtgcagtcgtccgcgtccaccttccgtcgttttggctattcactgggtcccgccagggcctccgaggcaaggggactgggagtggggtggcggtcagtatgggtgggatggaataatgctattttgngacagtacgtcgaggaacggccactcacctatccacgagacgcacgcctaacgaaacgtaaccttactttanctagtactaagtacgaaacgtgaacgacacgacacgcgtctcgtactagttcgcggacggtcggtacgacggaacgacggcggggtccggaccgtacgacggcgacggtcggaccg

SEQ ID NO: 334336 - DNA, 532 bp, Homo sapiens
  misc_feature: GZ8MTXP02GLWIU.25.35.D02.1.454.CMB.2.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
  modified_base (453)..(453): a, c, t, g, unknown or other
  misc_feature (453)..(453): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcggtcaccatctcctgcactggaaccngccgtgacattggncttataactatgtctcctggtcccaacacacccaggcaacggcccccaaactcatcatttangatgtcagtcatcggccctgtggtagtttctggtcgtcttctctcggcctcagtctggccacgtccggccctccctgacccagtccgtcggggctccgaggtctggaggacgagcttacttattattgctatttcatacagagacaccanagtctggtcgtcggcggaggtacctaaggtcgaccgtcgtcggtcaacgcccaaggcctacgccccgtggtacctaccg

SEQ ID NO: 334337 - DNA, 764 bp, Homo sapiens
  misc_feature: GZ8MTXP02JA42C.25.35.D02.1.454.CMB.2.raw
  modified_base (308)..(308): a, c, t, g, unknown or other
  misc_feature (308)..(308): n is a, c, g, or t
  modified_base (393)..(393): a, c, t, g, unknown or other
  misc_feature (393)..(393): n is a, c, g, or t
tcagactgtacagtcacgaccggtgctcgatttagcacacgatagttgggtttgggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtcgtccgcgtccaccttccgtcgtttggctattcacgtcgggtcccnccaggcctccgaggcaagggctgggagtggggtggcggtcagtagtgggtgggattgggaaagttaagtggtacttaatttttancggtactaaggtaccttccggtaggaaacggggtcccgaaccttccgaaccctaattcccgtacccgaagggacggcccaacggtacccttaacccgaaaacgtaaaccctttaacccttttttaaacgtcccttacggtaacccttaaaagtttaaccggtaaaaaaccccgggtttggaaaccggtaacccgttaccggtaaacccggaaccgtaccggggtaccttacggttacctttaaacgtttacccggttgggacccggggtacgggggttaccctaagggaaaacggtaaccggtacgggggttcccgggggacccgttacggtaacccggggacgtacggtacgggggacccgtcccggggg

SEQ ID NO: 334338 - DNA, 560 bp, Homo sapiens
  misc_feature: GZ8MTXP02FZXKB.25.35.D02.1.454.CMB.2.raw
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgcgtccaccttccgtcgtttggcattcactggtccnccaggctccaggcaaggggctggagtggggtggcggtcagtagtggtgggatgggaaagtatgctattttgngcagtctcgtaggacgggccactcaccatcncagacgcagctacaagtacctactttanctagactaagttacgaaaccgtgacgactacggaacgacgacgtctagtactattacgcggccggtcgggtactaggaacggtaacggcggggtccgggaccgtacggacggacacggtcggaccg

SEQ ID NO: 334339 - DNA, 639 bp, Homo sapiens
  misc_feature: GZ8MTXP02IRNLO.25.35.D02.1.454.CMB.2.raw
  modified_base (317)..(317): a, c, t, g, unknown or other
  misc_feature (317)..(317): n is a, c, g, or t
  modified_base (493)..(493): a, c, t, g, unknown or other
  misc_feature (493)..(493): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtgggcggaggtcggggggaggcggtggtccgaggccggggaagtccctgagctctcctgtgcagtcgtcccgcgtccaccttccgtcgtttggctattcacgtcgggtcccnccagggcctccgaggcaaggggctgggagtggggtggcggtacagtagtggggtaggataggaagtaagtgacttattttagcgacagtacctccggtggaaacgggcccgtactccaacgtactctcccaaggacggctacgcctaacccgaaataaacccttacctttttaacncgtaacgtaacttaaacgttaacggaaaccgtgaacgtacgtaccgaacgtaccgcggtcttacgtactacgttcgcggtacgggtacggtacacggaaacgacggtcggggtccggtccgtacggacgacgtacggtaccggcgg

SEQ ID NO: 334340 - DNA, 618 bp, Homo sapiens
  misc_feature: GZ8MTXP02FUOAY.25.35.D02.1.454.CMB.2.raw
  modified_base (318)..(318): a, c, t, g, unknown or other
  misc_feature (318)..(318): n is a, c, g, or t
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (459)..(459): a, c, t, g, unknown or other
  misc_feature (459)..(459): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtgggcggaggtcggggggaggcggtggtccgaggccggggaagtccctgacgacctctcctgtgcagtgtccgcgtcccaccttccgtcgtttggctattcacgtcgggtcccnccaggcctccgaggcgaagggactgggagtggggtggcgtcagtagtgggtcgggatggaagtatgacttatttgngcagcctcgtaggaacggccactcaccntcncgagacggcagctacgaaagtaccttacctttanctagactaattacgaaaacgtgaacgacgtacggaacgacgacggtcttcgtaccttagttaccgtcgggaccggtacgggggttactacgggaaacgtaaaccggtaacgggggtccggggtacccgtacggtaccggcgtaacggtcgggaacccgg

SEQ ID NO: 334341 - DNA, 610 bp, Homo sapiens
  misc_feature: GZ8MTXP02J1KT6.25.35.D02.1.454.CMB.2.raw
  modified_base (304)..(304): a, c, t, g, unknown or other
  misc_feature (304)..(304): n is a, c, g, or t
  modified_base (375)..(375): a, c, t, g, unknown or other
  misc_feature (375)..(375): n is a, c, g, or t
  modified_base (456)..(456): a, c, t, g, unknown or other
  misc_feature (456)..(456): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagagtgtccagtgtcagatgcaactggcggagtcgggggagcgtggtccaggccggggaatccctgagactctcctgtgcagtgtccgcgtccaccttccgtcgttttggctattcactgggtccnccagggctccgaggcaaggggctggagtggggtggcggtcagtagtggtgggatgggaatatgctattttncgcagactccgtaggaaagggtcccaactcaacccatcctccaggacggctacggctacccgaaagtacctacctttttanctagactaagttacggaaaccgtgaacgtacctacggaacgaccgtacgggtcttagtactaacgttaccgcgggaccgggtacggggtactaacggaaaccggacggtaacgggggtccgggaccgttacggacggccgaacggtcgggaccg

SEQ ID NO: 334342 - DNA, 533 bp, Homo sapiens
  misc_feature: GZ8MTXP02GVD0E.25.35.D02.1.454.CMB.2.raw
  modified_base (241)..(241): a, c, t, g, unknown or other
  misc_feature (241)..(241): n is a, c, g, or t
tcagactgtacagtcacgaccggtgctcgatttagcacacgatagttgggtttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctggtcccaacaacaccaggcaacgcccccaaatcatcatttatgatgtcagtcatcgcctctgagtttctggtcgccttctctggctccaagtctggcaactcggcctccctgaccatctcgggctccaggctgagacgaggctacttatatttgctatttcattacagtacgacaccaactagtctaggtgttcggcggacggaccaaaggttcgaacgtccgtcgtacgacgccgaacggtctcggtccccctgggtctaccgtctttcccgg

SEQ ID NO: 334343 - DNA, 735 bp, Homo sapiens
  misc_feature: GZ8MTXP02H02G9.25.35.D02.1.454.CMB.2.raw
  modified_base (306)..(306): a, c, t, g, unknown or other
  misc_feature (306)..(306): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaatccctgagactctcctgtgcagtgtccgcgtccaccttccgtcgtttggctattcacgtggtcccnccaggctccgaggcaagggctgggagtggggtggcggtcagtagtgggtagggatgggaaagtaacgtggacttaatttttgcgactaacggtacctccgggtaggaaacgggggtcccaactccaacccatcccgtaccgaaggacggccaaggtccctaacccgaaagtaaaccctttaacccttttttaagaccgttacgtaaccttaaaacgttaaaccggaaaacccgtgaaaccgtaccgtaccggaaaccgtaacccgtacgggtactttacggtttaaccttaacgttttacccggacggggtaccggggttaccggggttaacgtaaacggggtaaaacggtaacccggggtaaccgggggtcccggggtaacccgttaccgggtaaccggacggttaacgggttaccgggggaccccgg

SEQ ID NO: 334344 - DNA, 559 bp, Homo sapiens
  misc_feature: GZ8MTXP02GD0UV.25.35.D02.1.454.CMB.2.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (431)..(431): a, c, t, g, unknown or other
  misc_feature (431)..(431): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatgcctgagactctcctgtgcagtgtccgcgtccaccttccgtcgttttggcattcacgtgggtccnccaggctccaggcaaggggctgggagtggggtggcggtcatagtggtgggatgggaataangctattttangacagctcggagacgggccactcacatcacagngcancacaagtaacttactttanctagactaatacgaaacgtgacgtactacgacgacgacgtctacgtacttattacgtcggaccgggtcgggtactaggaaacggtaacgacggggtacccggggccgttacgtaccggctacggtcgg

SEQ ID NO: 334345 - DNA, 521 bp, Homo sapiens
  misc_feature: GZ8MTXP02G7K4V.25.35.D02.1.454.CMB.2.raw
  modified_base (240)..(240): a, c, t, g, unknown or other
  misc_feature (240)..(240): n is a, c, g, or t
tcagactgtacagtcacgaccggtgctcgatttagcacacgatagttgggtttggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggngcttatgacactgtctctggcaccagttttacccaggaaaacgcccccagacgtcatcctttatgatgtcaggaagcggccctcaggggtccctgactcgcttctctggtccaaatctggcaacacgcctcctgaccatctctggctcgagctgagatgagctagtattattattgacttgttcatatgcaggcaactatatttggtgttcggcgcgacgggacctaagttcgaacccgtcgtgggtaccgacggacccgaacggtccgtaccgtcccccg

SEQ ID NO: 334346 - DNA, 595 bp, Homo sapiens
  misc_feature: GZ8MTXP02GSU18.25.35.D02.1.454.CMB.2.raw
  modified_base (371)..(371): a, c, t, g, unknown or other
  misc_feature (371)..(371): n is a, c, g, or t
  modified_base (431)..(431): a, c, t, g, unknown or other
  misc_feature (431)..(431): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtgtccgcgtccaccttccgtcgttttggctattcactgggtccgccaggctccgaggcaaagggctggagtggggtgcggtcatagtggtgggatggaagtatgcattttngacagactcgagacggccactcaccatcacgagacgcacgctacaaacgtactactttanctagactaagttaacggaaaaccgtgaacgactacggaacgaacgacggtcttagtacttaacgttacgtcggacggtaccggggtactaacgggaaacggtaaaccggtaacggggttacccggggacccgttacgaaccgggacgtaacggtacgggaccgg

SEQ ID NO: 334347 - DNA, 695 bp, Homo sapiens
  misc_feature: GZ8MTXP02F51IP.25.35.D02.1.454.CMB.2.raw
  modified_base (243)..(243): a, c, t, g, unknown or other
  misc_feature (243)..(243): n is a, c, g, or t
tcagactgtacagtcacgaccggtgctcgatttagcacacgatagttgggtttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcgttggtncttatgacactgtctcctgcacctacgttaaccaaggaaacgccccagacgtctacttccttatgatgtacgaaggacgccggtcccgtcgacgggtccctgacctcgtccttcgtcgttcggtacctaaagtcgtacgacctaaaccgacccgtccctaccccgtacgaaccctacttccgtcggtcggggtccctacccggtaggtaccgtaggaggtaagtacgggagtacgttaggttaatttaagtttaacgtttgtaccgtttaggttaccttaaagttagttaccgtacgaaacggtaaccgttaaactttaccgtttaaggttttcgggttacgggtttccgggaccggtaacggtaacgggtaaccgttaaacggttccggtaacccggttccggtacggtaccgacggaccccgtaaacggtccccgtacccggtcccccgg

SEQ ID NO: 334348 - DNA, 686 bp, Homo sapiens
  misc_feature: GZ8MTXP02G8VC1.25.35.D02.1.454.CMB.2.raw
  modified_base (312)..(312): a, c, t, g, unknown or other
  misc_feature (312)..(312): n is a, c, g, or t
  modified_base (390)..(390): a, c, t, g, unknown or other
  misc_feature (390)..(390): n is a, c, g, or t
  modified_base (497)..(497): a, c, t, g, unknown or other
  misc_feature (497)..(497): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccgaggccggggaagtccctgagactctcctgtgcagtgtccgcgtccaccttccgtcgttttgctattcacgtcgggtcccnccaggcctccgaggccgaaggggctgggagtggggtggcggtcagtagtggtgggatgggaagtaatgactattttgngacagacctccggtaggaaacggggcccgactccaaccgtactccgtacccgaaaggacggaccacggtaccctaaccgaaaacgtaaacccttacccgtttttaancccgttaggtaacctaaagtttaacggaaaacccgttgaaccgtacctacggaaccgacgaccggtcttacgttacttaacgtttaccgcgggtaccgggtaccgggggttacaacgggtaaaaccggaaccggtaacgggggttcccggggacccgttaccggacggaccgtaggtccgggaacccgg

SEQ ID NO: 334349 - DNA, 592 bp, Homo sapiens
  misc_feature: GZ8MTXP02FPRN4.25.35.D02.1.454.CMB.2.raw
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
  modified_base (431)..(431): a, c, t, g, unknown or other
  misc_feature (431)..(431): n is a, c, g, or t
tcagactgtacagtcacgaccggtgctcgatttagcacacgatagttgggtttggggagctctgggagaggagcccagcactagaagtcggcggtgtttccatccggtgatcagcattgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtcgtttggcattcactgggtccnccaggctccgaggcaagggctggagtgggtggcggtcagtagtggtgggatggaagtatgctatttngcagactccgtagaacggggccactcaccatctccagagcagctcaaagactaccttttanctagactaagtacgaaacgtgacgtactacgaacgacgacgtcttacgtacttacgttacgtcgggaccgggtacggggttactaacgggaaacggtaaaccggtaacgggggtcccgggggtacccgtacggtaccggaccgtacggtaccgggacccgg

SEQ ID NO: 334350 - DNA, 719 bp, Homo sapiens
  misc_feature: GZ8MTXP02G70KP.25.35.D02.1.454.CMB.2.raw
  modified_base (312)..(312): a, c, t, g, unknown or other
  misc_feature (312)..(312): n is a, c, g, or t
  modified_base (506)..(506): a, c, t, g, unknown or other
  misc_feature (506)..(506): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtcgtccgcgtcccaccttccgtcgttttggctattcactcgggtccnccaggcctccgaggcgaagggctgggaggtggggtggcggtcagtagtgggtgggatggaagtatgtactattttgcgacagtaccgtccggtaggaaacggggcccgtaacttcccgaaccctagtcccgtacccgaaggggacggccacggtacccttaacccgaaaagtaaaccctttaccctttttaacnccgtaggtaaccctaaagtttacggaaaaacccgttgaaacgtaccgtaccggaacgtaccgacgggtacttacggtaccttaacgtttaccgcggggtacccgggtacgggggttacctaaaaggggaaccggtaaaaccggtaacggggggttcccgggggacccggttaccggtaaccggggacctaaggggttcgggaaacccccgggg

SEQ ID NO: 334351 - DNA, 630 bp, Homo sapiens
  misc_feature: GZ8MTXP02G3O49.25.35.D02.1.454.CMB.2.raw
  modified_base (309)..(309): a, c, t, g, unknown or other
  misc_feature (309)..(309): n is a, c, g, or t
  modified_base (477)..(477): a, c, t, g, unknown or other
  misc_feature (477)..(477): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggaatccctgacgactctcctgtgcagtcgtccgcgtcccaccttccgtcgtttgctattcacgtgggtccnccagggcctccgaggccaaggggactgggagtggggtggcggtcagtagtgggtggggatagggaagtaactggacttaatttttgcgcaggtacctccggtaggaacggggcccactcaacctatccgtaccagaggccagcctaccaaacgtacttaccgttttanactagactaagtaacgaaacgtcgaacgacacgacgacgtacgtctacgttactacgttcgcgggtacgggtacgggtacaacggaaaccggtaacgggtccgggggttaccgggacccgttacggaccggtacgtacgggtacgggacccgg

SEQ ID NO: 334352 - DNA, 671 bp, Homo sapiens
  misc_feature: GZ8MTXP02HLKY3.25.35.D02.1.454.CMB.2.raw
  modified_base (319)..(319): a, c, t, g, unknown or other
  misc_feature (319)..(319): n is a, c, g, or t
  modified_base (416)..(416): a, c, t, g, unknown or other
  misc_feature (416)..(416): n is a, c, g, or t
  modified_base (517)..(517): a, c, t, g, unknown or other
  misc_feature (517)..(517): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcggggggaggcggtggtccaggccgggggaagtcccgtgagactctcctgtgcagtcgtccgcgtcccaccttccgtcgtttggctattccacgtcgggtccnccgaggcctccgagggcaaggggtactgggaggtggggtggcggtcagtaggtggggtagggagtagggaaagttaagtcggtacttaatttttagngactaagtaccgtccggtagggaaacgggtcccaaactccaacctacgtccgtaccgaggacggcaacgccctaaccgaaacgtaaaccttacctttttanctacgtaactaaagttaacgaaaaccgtgaacgaccgtacggaacgaccgacgtcttacgttactaacgttcggcggtccgggtacgggtacgaacggaacggtaacggcggggtacccgggtaccgtacggacggcgtacggtaccgggaccg

SEQ ID NO: 334353 - DNA, 721 bp, Homo sapiens
  misc_feature: GZ8MTXP02IPE8J.25.35.D02.1.454.CMB.2.raw
  modified_base (181)..(181): a, c, t, g, unknown or other
  misc_feature (181)..(181): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (524)..(524): a, c, t, g, unknown or other
  misc_feature (524)..(524): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagnggtgtccagtgtcagatgcaactggcggaggtcgggggaggcgtggtccgaggccggggaagtccctggacgactctcctgtgcagtcgtccgcgtccaccttccgtcgtttggctattcacgtcggtcccgccaggcctccgaggccgaagggactggaggtgggtggcgtnatagtggngggatgggaaattagtgtactattttagcgactaagtaccgttcccggtagggaaaccgggtcccgtaaaccgtccaaccctaacgttcccgacccgaagggaccggacctaacgggtacccttaacccgaaaacgtaaaccccttaacccgttttttaaanccgttacgaaccttaaacgtttaaccggaaaaaacccgttcgaacgtaccgtacggaaaccggacgtaacgggtcttacggttacttaacgtttcgtcgggtccggggtaccggggttcgtaacggaacgggtaaccgtaacgggggtcccggggtacccgttacggtaccgggacgtaggtaccggggtacccggg

SEQ ID NO: 334354 - DNA, 608 bp, Homo sapiens
  misc_feature: GZ8MTXP02FRJ9R.25.35.D02.1.454.CMB.2.raw
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
  modified_base (458)..(458): a, c, t, g, unknown or other
  misc_feature (458)..(458): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaatccctgagactctcctgtgcagtgtccgcgtccaccttccgtcgttttggctattcactgggtccncaggctccgaggcaagggctgggagtggggtggcgtcatagtgggtgggatgggaaagtaatgactatttttcgngacagtacctcggtaggaacgggccactccaccatccacgagacgcctacgacctaccaaacgtaaccttacctttancctagaactaagttaacgaaaccgtgaacgtacgtacgaacgacgacgtcttacgtacttacgttacgtcggtaccgggtacgggtactaacggaacggtaacggtaacggggtccgggtaccgtacgacggacgtacggtacgggaccg

SEQ ID NO: 334355 - DNA, 531 bp, Homo sapiens
  misc_feature: GZ8MTXP02I13WD.25.35.D02.1.454.CMB.2.raw
  modified_base (303)..(303): a, c, t, g, unknown or other
  misc_feature (303)..(303): n is a, c, g, or t
  modified_base (368)..(368): a, c, t, g, unknown or other
  misc_feature (368)..(368): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaagtccctgagactctcctgtgcagtgtccgcgtccaccttccgtcgtttggctattcactggtccncaggctccaggcaagggctggagtgggtggcggtcatagtggtgggatggaagtaatgctatttngcagactccgtgaagggccactcacatctccagacgcagctaccaagaactacctttatctagactaattagaaaacccgtgagactcgacgacacggctagtctattacgcgcggcgggtctagaagtacgaaggtcgggacgtcgtacggcagtcggaccg

SEQ ID NO: 334356 - DNA, 619 bp, Homo sapiens
  misc_feature: GZ8MTXP02HTWLK.25.35.D02.1.454.CMB.2.raw
  modified_base (316)..(316): a, c, t, g, unknown or other
  misc_feature (316)..(316): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagactgtacagtcacgaccggtgctcgatttagcacacgatagttgggtttggggagctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggagcgtggtccaggccggggaatcccgtgagactctcctgtgcagtgtcccgcgtccctaccttccggtcgttttaggcattccactgggtccccnccagggcctccgaggcgaaaggggctgggagtgggtggcggtnagtagtgggngggataggggaaataatggatatttttagngacagtaccgtacgacggaacggcccactacaccactccacgagacgctacgactaaccgaactaaaccttacgtttanacgttanaactaagtaacgaaacgtgaacgacgacgaccgaacgacgtctagttacttacgtacgtggccggtcgggtaacaacggaacggaacggtaacggggtaccgggaccgtacgtacggacgtacggtacggaccg
